United States Patent
Hauge et al.

(10) Patent No.: US 7,154,021 B2
(45) Date of Patent: Dec. 26, 2006

(54) NUCLEIC ACID MOLECULES AND OTHER MOLECULES ASSOCIATED WITH SOYBEAN CYST NEMATODE RESISTANCE

(75) Inventors: Brian M. Hauge, Beverly, MA (US); Ming Li Wang, Lexington, MA (US); Jeremy David Parsons, Cambridge (GB); Laurence David Parnell, Cambridge, MA (US)

(73) Assignee: Monsanto Technology LLC, St. Louis, MO (US)

( * ) Notice: Subject to any disclaimer, the term of this patent is extended or adjusted under 35 U.S.C. 154(b) by 367 days.

(21) Appl. No.: 09/754,853

(22) Filed: Jan. 5, 2001

(65) Prior Publication Data

US 2003/0005491 A1 Jan. 2, 2003

Related U.S. Application Data

(60) Provisional application No. 60/174,880, filed on Jan. 7, 2000.

(51) Int. Cl.
*A01H 1/00* (2006.01)
(52) U.S. Cl. .................. 800/267; 800/265; 800/266
(58) Field of Classification Search .............. 800/260, 800/265, 267, 312
See application file for complete search history.

(56) References Cited

U.S. PATENT DOCUMENTS

| | | | | |
|---|---|---|---|---|
| 5,491,081 | A | 2/1996 | Webb | 800/267 |
| 6,096,944 | A | 8/2000 | Vierling et al. | 800/265 |
| 6,162,967 | A | 12/2000 | Webb | 800/312 |
| 6,228,992 | B1 | 5/2001 | Jessen et al. | 530/370 |
| 6,284,948 | B1 | 9/2001 | Jessen et al. | 800/301 |
| 6,300,541 | B1 * | 10/2001 | Lightfoot et al. | 800/267 |
| 6,538,175 | B1 | 3/2003 | Webb | 800/265 |
| 2002/0129402 | A1 | 9/2002 | Lightfoot et al. | 800/278 |
| 2002/0144310 | A1 | 10/2002 | Lightfoot et al. | 800/312 |
| 2003/0135881 | A1 | 7/2003 | Webb | 800/279 |

FOREIGN PATENT DOCUMENTS

| WO | WO 95 20669 A2 | 8/1995 |
|---|---|---|
| WO | WO 01/51627 A3 | 6/2002 |

OTHER PUBLICATIONS

Staub and Serquen 1996, HortScience 31(5):729-738.*
Forugoux-Nicol et al 1999, Plant Molecular Biology 40:857-872.*
Zhu et al 2003, Genetics 163:1123-1134.*
Rafalski 2002, Plant Science 162: 329-333.*
J.D. Thompson et al., Clustal W: Improving the sensitivity of progressive multiple sequence alignment through sequence weighting, position-specific gap penalties and weight matrix choice. Nucleic Acids Research, (1994) vol. 22, No. 22., pp. 4673-4680.
Wen-Yuan Song, et al., A receptor Kinase-Like Protein Encoded by the Rice Disease Resistance Gene, Xa21., Science 270 (1995) pp. 1804-1806.
Concibido et al., Cell Biology & Molecular Genetics RFLP mapping and Marker-Assisted Selected of Soybean Cyst Nematode Resistance in PI 209332., Crop. Sci. 36 (1996) pp. 1643-1650.
Mansur et al., Generation Mean Analysis of Resistance to Race 3 of Soybean Cyst Nematode., Crop Sci. 33 (1993) pp. 1249-1253.
Rao-Arelli et al., Genetic Relationships Among Soybean Plant Introductions for Resistance to Race 3 of Soybean Cyst Nematode., Crop Sc., 28 (1988) pp. 650-652.
Concibido et al., Targeted Comparative Genome Analysis and Qualitative Mapping of a Major Partial-Resistance Gene to the Soybean cyst Nematode., Theor Appl. Genet. (1996) 93:234-241.
Kobe et al., A Structural Basis of the Interactions Between Leucine-Rich Repeats and Protein Ligands., Nature vol. 374 (1995) pp. 183-186.
Cregan et al., Two Simple Sequence Repeat Markets to Select for Soybean Cyst Nematode Resistance Conditioned by the *Rhg1* Locus., Theor Appl. Genet. (1999) 99:811-818.
Qui et al. RFLP Markers Associated with Soybean Cyst Nematode Resistance and Seed Composition in a 'Peking' x 'Essex' Population., Theor Appl. Genet 98:356-364 (1999).
Concibido et al., Genome Mapping of Soybean Cyst Nematode Resistance Genes of 'Peking', PI 90763 and PI 88788 Using DNA markers., Crop Sci. 37:258-264 (1997).
Jones et al., The Role of Leucine-Rich Repeat Proteins and Plant Defences, Adv. Bot. Res. Incorp. Ad. Plant Path 24:89-167 (1997).
Matson and Williams, Evidence of a Fourth Gene For Resistance to the Soybean Cyst Nematode., Crop Sci. 5:447 (1965).

(Continued)

*Primary Examiner*—David H Kruse
(74) *Attorney, Agent, or Firm*—Thomas E. Kelley; Lawrence M. Lavin, Jr.; Arnold & Porter LLP

(57) ABSTRACT

The present invention is in the field of soybean genetics. More specifically, the invention relates to nucleic acid molecules from regions the soybean genome, which are associated with soybean cyst nematode resistance. The invention also relates to proteins encoded by such nucleic acid molecules as well as antibodies capable of recognizing these proteins. The invention also relates to nucleic acid markers from regions the soybean genome, which are associated with soybean cyst nematode resistance. Moreover, the invention relates to uses of such molecules, including, transforming soybean cyst nematode resistant soybean with constructs containing nucleic acid molecules from regions the soybean genome, which are associated with soybean cyst nematode resistance. Furthermore, the invention relates to the use of such molecules in a plant breeding program.

14 Claims, 1 Drawing Sheet

OTHER PUBLICATIONS

Concibido, V.C., et al., "A Common Soybean Cyst Nematode Resistance Gene," *Phytopathology*, vol. 85(10):1140 (1995).

Dong, K., et al., "Genetics of Soybean-*Heterodera glycines* Interactions," *Journal of Nematology*, vol. 29(4):509-522 (1997).

Prabhu, R. R., et al., "Selecting Soybean Cultivars for Dual Resistance to Soybean Cyst Nematode and Sudden Death Syndrome Using Two DNA Markers," *Crop Science*, vol. 39(4):982-987 (Jul.-Aug. 1999).

Concibido et al., "A Decade of QTL Mapping for Cyst Nematode Resistance in Soybean", *Crop Science*, 44(4):1121-1131 (2004).

Lange et al., "A Plant DNA Isolation Protocol Suitable for Polymerase Chain Reaction Based Marker-Assisted Breeding", *Crop Science*, 38:217-220 (1998).

Matthews et al., "Molecular Markers Residing Close to the *Rhg4* Locus Conferring Resistance to Soybean Cyst Nematode Race 3 on Linkage Group A of Soybean", *Theor. Appl. Genet.*, 97:1047-1052 (1998).

Meksem et al.; "Clustering Among LOCI Underlying Soybean Resistance to *Fusarium solani*, SDS and SCN in Near-Isogenic Lines", *Theor. Appl. Genet.*, 99:1131-1142 (1999).

Meksem et al., "Conversion of AFLP Bands into High-Throughput DNA Markers", *Mol. Genet. Genomics*, 265:207-214 (2001).

Meksem et al., "'Forrest' Resistance to the Soybean Cyst Nematode is Bigenic: Saturation Mapping of the *Rhg1* and *Rhg4* LOCI", *Theor. Appl. Gene.*, 103:710-717 (2001).

Meksem et al., "Two Large-Insert Soybean Genomic Libraries constructed in a Binary Vector: Applications in Chromosome Walking and Genome Wide Physical Mapping", *Theor. Appl. Gene.*, 101:747-755 (2000).

Meksem et al., "High-Throughput Genotyping for a Polymorphism Linked to Soybean Cyst Nematode Resistance Gene *Rhg4* by Using Taqman™ Probes", *Molecular Breeding*, 7:63-71 (2001).

Bell-Johnson et al., "Biotechnology Approaches to Improving Resistance to SCN and SDS: Methods for High Throughput Marker Assisted Selection", *Soybean Genetics Newsletter*, 25:115-117 (1998).

Boutin et al., "RFLP Analysis of Cyst Nematode Resistance in Soybeans", *Soybean Genetics Newsletter*, 19:123-127 (1992).

Chang et al., "Association of Loci Underlying Field Resistance to Soybean Sudden Death Syndrome (SDS) and Cyst Nematode (SCN) Race 3", *Crop Sci.*, 37(3):965-971 (1997).

Concibido et al., "DNA Marker Analysis of Loci Underlying Resistance to Soybean Cyst Nematode (*Heterodera Glycines Ichinohe*)", *Crop Sci.*, 34(1):240-246 (1994).

Concibido et al., "RFLP Mapping of Cyst Nematode Resistance Genes in Soybeans", *Soybean Genetics Newsletter*, 20:136-139 (1993).

Mahalingam et al., "Cytological Expression of Early Response to Infection by *Heterodera gylcines Ichinohe* in Resistant PI 437654 Soybean", *Genome*, 39:986-998 (1996).

Mahalingam et al., "DNA Markers for Resistance to *Heterodera glycines I*. Race 3 in Soybean Cultivar Peking", *Breeding Science*, 45:435-443 (1995).

Meksem et al., "A High-Resolution Map of the Vicinity of the R1 Locus on Chromosome V of Potato Based on RFLP and AFLP Markers", *Mol Gen Genet*, 249:74-81 (1995).

Webb et al., "Genetic Mapping of Soybean Cyst Nematode Race-3 Resistance LOCI in the Soybean P1 437.654", *Theor Appl Genet*, 91(1):574-581 (1995).

* cited by examiner rhg1 LRR

| | consensus LRR | L F S N L P | N L E E L D L S N N | L T | S L P P G |
|---|---|---|---|---|---|
| | | a x x a x | x L x x L x L x x N | L | I |
| LRR 177-200 | | T L G L L P | G L R K L S L H D N Q | I G | G S I P S |
| LRR 201-224 | | S L G F C P | N L R G V Q L F N N R | L T | G S I P L |
| LRR 225-248 | | L A N S T | L L Q S L D L S N N L | L T | G A I P Y S |
| LRR 249-272 | | L T H S F | K L Y W L N L S F N S | F S | G P L P A S |
| LRR 273-297 | | W G G N S K | S L T F L S L Q N N N | L S | G S L P N S |
| LRR 302-325 | | L G S L R | R L Q N L I L D H N F | F T | G D V P A S |
| LRR 326-349 | | I G T L S | E L N E L S L S H N K | F S | G A I P N E |
| LRR 350-373 | | T L S N L S | R L K T L D I S N N A | L N | G N L P A |
| LRR 374-397 | | S L G R L R | S L T L L N A E N N L | L D | N Q I P Q |
| LRR 398-421 | | S I A N I S | N L S V L I L S R N Q | F S | G H I P S |
| LRR 422-445 | | S F D S Q R | S L R Q L D L S L N N | F S | G E I P V |
| LLR 446-470 | | L L A K K F N S L | N L F N V S N S | L S | G S V P P |

Figure 1

Rhg4 LRR

| | consensus LRR | L F S N L P | N L E E L D L S N N | L T | S L P P G |
|---|---|---|---|---|---|
| LRR 34-57 | | | H V T S I S L A S H S | L T | G T L P S D |
| LRR 58-80 | | L N S L S | Q L R T L S L Q D N S | L | G T L P S |
| LRR 81-104 | | L S N L S | F L Q T V Y L N R N N | F S | S V P T |
| LRR 105-130 | | A F A S L T | S L Q T L S L G S N P | A L Q P | W S F P T D |
| LRR 131-154 | | L T S S S | N L I D L D L A T V S | L T | G P L P D I |
| LRR 155-178 | | F D K F P | S L Q H L R L S Y N N | L T | G N L P S S |
| LRR 179-203 | | F S A A N | N L E T L W L N N Q A A | G L S | G T L L |
| LRR 227-250 | | L S N M S | A L S D L Q L R D N Q | L T | G V V P A |
| LRR 251-274 | | S L T S L P | S L K K V S L D N N E | L Q | G P V P V |
| LRR 333-356 | | F G K G V N | K I I T V N F E K Q G | L Q | G T I S P |
| LRR 357-380 | | A F A N L T | D L R T L F L N G N N | L I | G S I P D |
| LRR 381-404 | | S L I T L P | Q L Q T L D V S D N N | L S | G L V P K |
| | | F P P K V K | | | |

Figure 2

NUCLEIC ACID MOLECULES AND OTHER MOLECULES ASSOCIATED WITH SOYBEAN CYST NEMATODE RESISTANCE

CROSS-REFERENCE TO RELATED APPLICATION

This application claims priority under 35 U.S.C. §119(e) of U.S. Application No. 60/174,880, filed Jan. 7, 2000, the disclosure of which is herein incorporated by reference in its entirety.

FIELD OF THE INVENTION

The present invention is in the field of soybean genetics. More specifically, the invention relates to nucleic acid molecules from regions of the soybean genome, which are associated with soybean cyst nematode (SCN) resistance. The invention also relates to proteins encoded by such nucleic acid molecules as well as antibodies capable of recognizing these proteins. The invention also relates to nucleic acid markers from regions of the soybean genome, which are associated with SCN resistance. Moreover, the invention relates to uses of such molecules, including, transforming SCN sensitive soybean with constructs containing nucleic acid molecules from regions in the soybean genome, which are associated with SCN resistance. Furthermore, the invention relates to the use of such molecules in a plant breeding program.

BACKGROUND OF THE INVENTION

The soybean, *Glycine max* (L.) Merril (*Glycine max* or soybean), is one of the major economic crops grown worldwide as a primary source of vegetable oil and protein (Sinclair and Backman, *Compendium of Soybean Diseases*, 3$^{rd}$ Ed. APS Press, St. Paul, Minn., p. 106. (1989)). The growing demand for low cholesterol and high fiber diets has also increased soybean's importance as a health food.

Prior to 1940, soybean cultivars were either direct releases of introductions brought from Asia or pure line selections from genetically diverse plant introductions. The soybean plant was primarily used as a hay crop in the early part of the 19th century. Only a few introductions were large-seeded types useful for feed grain and oil production. From the mid 1930's through the 1960's, gains in soybean seed yields were achieved by changing the breeding method from evaluation and selection of introduced germplasm to crossing elite by elite lines. The continuous cycle of cross hybridizing the elite strains selected from the progenies of previous crosses resulted in the modem day cultivars.

Over 10,000 soybean strains have now been introduced into the United States since the early 1900's (Bernard et al., *United States National Gennplasm Collections*. In: L. D. Hil (ed.), World Soybean Research, pp. 286–289. Interstate Printers and Publ., Danville, Ill. (1976)). A limited number of those introductions form the genetic base of cultivars developed from the hybridization and selection programs (Johnson and Bernard, The Soybean, Norman Ed., Academic Press, N.Y., pp. 1–73 (1963)). For example, in a survey conducted by Specht and Williams, *Genetic Contributions*, Fehr eds. American Soil Association, Wisconsin, pp. 49–73 (1984), for the 136 cultivars released from 1939 to 1989, only 16 different introductions were the source of cytoplasm for 121 of that 136. Certain soybean strains are sensitive to one or more pathogens. One economically important pathogen is SCN.

SCN accounts for roughly 40% of the total disease in soybean and can result in significant yield losses (up to 90%). SCN is the most destructive pest of soybean to date and accounts for an estimated yield loss of up to $809 million dollars annually. Currently, the most cost effective control measures are crop rotation and the use of host plant resistance. While breeders have successfully developed SCN resistant soybean lines, breeding is both difficult and time consuming due to the complex and polygenic nature of resistance. The resistance is often race specific and does not provide stability over time due to changing SCN populations in the field. In addition, many of the resistant soybean varieties carry a significant yield penalty when grown in the absence of SCN.

SCN, *Heterodera glycines Ichinohe*, was identified on soybeans in the United States in 1954 at Castle Hayne, N.C. Winstead, et al., *Plant Dis. Rep.* 39:9–11 (1955). Since its discovery the SCN has been recognized as one of the most destructive pests in soybean. It has been reported in nearly all states in which soybeans are grown, and it causes major production problems in several states, being particularly destructive in the Midwestern states. See generally: Caldwell, et al., *Agron. J.* 52:635–636 (1960); Rao-Arelli and Anand, *Crop. Sci.* 28:650–652, (1988); Baltazar and Mansur, *Soybean Genet. Newsl.* 19:120–122 (1992); Concibido, et al., *Crop. Sci.*, (1993). For example, sensitive soybean cultivars had 5.7–35.8% lower seed yields than did resistant cultivars on SCN race-3 infested sites in Iowa. (Niblack and Norton, *Plant Dis.* 76:943–948 (1992)).

Shortly after the discovery of SCN in the United States, sources of SCN resistance were identified (Ross and Brim, *Plant Dis. Rep.* 41:923–924 (1957)). Some lines such as Peking and Plant Introduction (PI) PI88788, were quickly incorporated into breeding programs. Peking became widely used as a source of resistance due to its lack of agronomically undesirable traits, with Pickett as the first SCN resistant cultivar released (Brim and Ross, *Crop Sci.* 6:305 (1966)). The recognition that certain SCN resistant populations could overcome resistant cultivars lead to an extensive screen for additional sources of SCN resistance. PI88788 emerged as a popular source of race 3 and 4 resistance even though it had a cyst index greater than 10% (but less than 20%) against race 4, and Peking and its derivatives emerged as a popular source for races 1 and 3. PI437654 was subsequently identified as having resistance to all known races and its SCN resistance was backcrossed into Forrest. Currently there are more than 130 PIs known to have SCN resistance.

SCN race 3 is considered to be the prominent race in the Midwestern soybean producing states. Considerable effort has been devoted to the genetics and breeding for resistance to race 3. While both Peking and PI88788 are resistant to SCN race 3, classical genetics studies suggest that they harbor different genes for race 3 resistance (Rao-Arelli and Anand, *Crop Sci.* 28:650–652 (1988)). Crosses between PI88788(R) and Essex(S) segregate 9(R): 55(S) in the $F_2$ population and 1(R): 26(Seg): 37(S) families in the $F_3$ generation, suggesting that resistance to race 3 in PI88788 is conditioned by one recessive and two dominant genes, where as Peking and PI90763 resistance is conditioned by one dominant and two recessive genes. Based on reciprocal crosses, Peking, Forrest, and PI90763 have genes in common for resistance to SCN race 3 (Rao-Arelli and Anand, *Crop Sci.*, 28:650–652 (1988)). A cross between Peking and PI88788 segregates 13(R):3(S) in the $F_2$ generation, indicating a major difference between the parents for race 3 resistance. Generation mean analysis based on four crosses between resistant and sensitive genotypes; A20 (R), Jack (R), Cordell (R) and A2234 (S), suggests that an additive genetic model is sufficient to explain most of the genetic variation of race 3 SCN resistance in each cross, while the analysis of the pooled data indicates the presence of dominant effects as well (Mansur, Carriquiry and Roa-Arelli, Crop Sci. 33:1249–1253 (1993)). This analysis further indicates that race 3 resistance is probably under the genetic control of three, but not more than four genes.

RFLP analysis of segregating populations between resistant and sensitive lines; PI209332 (R), PI90763 (R), PI88788 (R), Peking (R) and Evan (S), identified a major SCN resistance QTL (rhg1) which maps to linkage group G (Concibido et al., Theor Appl. Genet. 93:234–241 (1996)). In this study, rhg1 explains 51.4% of the phenotypic variation in PI209322, 52.7% of the variation in PI90763, 40.0% of the variation in PI88788 and 28.1% of the variation in Peking. This major resistance QTL was assumed be one and the same in all of the mapping populations employed. However, as pointed out by the authors, it is possible that the genomic interval contains distinct but tightly linked QTLs. In a related study using PI209332 as the source of resistance, Concibido et al., Crop Sci. 36:1643–1650 (1996), show that a QTh on linkage group G (rhg1) is effective against the three SCN races tested, explaining 35% of the phenotypic variation to race 1, 50% of the variation to race 3, and 54% of the variation to race 6. In addition to the major QTL on linkage group G, 4 other QTLs mapping to linkage groups D, J, L and K were identified, with some of the resistance loci behaving in a race specific manner.

Concibido et al. (Crop Sci. 37:258–264 (1997)) found significant association of marker C006V to a major QTL on linkage group G (rhg1) and resistance to race 1, race 3 and race 6, in Peking and PI90763 (Evan X Peking, Evan X PI90763) and races 3 and 6 in PI88788 (Evan X PI88788), in agreement with the previous study based on the P209332 source of resistance (Concibido et al., Crop Sci. 36:1643–1650 (1996)). The resistance locus near C006V was effective against all races tested in all of the resistance sources. While statistically significant against all races, this locus accounts for different proportions of the total phenotypic variation with the races tested. For example, in PI90763 the resistance locus near C006V explains more than three times the phenotypic variation against race 1 than against race 3. The variability can be attributed to differences in the genetic backgrounds, variability among the SCN populations or may be a reflection of the limited size of the plant populations which were employed. This study further identified three additional independent SCN resistance QTLs; one near the RFLP marker A378H mapping to the opposite end of linkage group G from C006V (rhg1), one near the marker B032V-1 on linkage group J and a third linked to A280Hae-1 on linkage group N. Comparisons between the different SCN races indicated that some of the putative SCN QTLs behave in a race specific manner.

PI437654 was identified as having resistance to all known races. Based on analysis of 328 recombinant inbreed lines (RIL) derived from a cross between PI437654 and BSR101, Webb reported six QTLs associated with SCN resistance on linkage groups A2, C1, G, M, L25 and L26 (U.S. Pat. No. 5,491,081). An allele on linkage group G, presumed to be rhg1, is involved with certain SCN races tested (races 1, 2, 3, 5 and 14), and has the largest reported phenotypic effect on resistance to every race. In contrast, the QTLs on linkage groups A2, C1, M, L25 and L26 act in a race specific manner. The QTL on linkage group L25 was reportedly involved with four of the five races, while the QTLs on linkage groups, A2, C1 and L26 were each involved in resistance to two of the five races (U.S. Pat. No. 5,491,081). Webb further reports data that the resistance to any of the five races is likely to result from the combined effects of the QTL involved in each race (U.S. Pat. No. 5,491,081).

Qui et al. (Theor Appl Genet 98:356–364 (1999)) screened 200 $F_{2:3}$ families derived from a cross between Peking and Essex and identified RFLP markers which are associated with SCN resistance QTLs on linkage groups B, E, I and H. The three QTLs on linkage groups B, E and H jointly account for 57.7% of the phenotypic variation to race 1, the QTLs on linkage groups H and B account for 21.4% of the variation to race 3, while the QTLs on linkage groups I and E are associated with resistance to race 5 accounting for 14.0% of the phenotypic variation. In contrast to previous mapping studies which use Peking as the source of resistance, no significant association was detected to the rhg1 locus on linkage group G. The authors point out that the marker Bng122, which has been shown to have significant linkage to rhg1, is not polymorphic in the population employed (Concibido et al., Crop Sci. 36:1643–1650 (1996)).

It has been reported that the rhg1 locus on linkage group G is necessary for the development of resistance to any of the SCN races. There have been efforts to develop molecular markers to identify breeding lines harboring the rhg1 SCN resistant allele. One of the most commonly used markers for marker assisted selection (MAS) of rhg1 is an SSR locus that co-segregates and maps roughly 0.4 cM from rhg1. This SRR marker, BARC-Satt__309 is able to distinguish most, if not all, of the SCN sensitive genotypes from those harboring rhg1 from important sources of resistance such as Peking and PI437654. Two simple sequence repeat markers have been reported that can be used to select for SCN resistance at the rhg1 locus (Concibido et al., Theor Appl Genet 99: 811–818 (1999)). Satt__309 was also effective in distinguishing SCN resistant sources PI88788 and PI209332 in many, but not all, sensitive genotypes. In particular, Satt__309 can not be used for MAS in populations developed from "typical" southern US cultivars (e.g., Lee, Bragg and Essex) crossed with resistance sources PI88788 or PI209332.

Matson and Williams have reported a dominant SCN resistance locus, Rhg4, which is tightly linked to the 'i' locus on linkage group A2 (Matson and Williams, Crop Sci. 5:447 (1965)). The QTL reported by Webb on linkage group A2 maps near the 'i' locus and is considered to be Rhg4 (U.S. Pat. No. 5,491,081). Webb concludes that only two loci on linkage groups A2 (Rhg4) and G (rhg1) explain the genetic variation to race 3.

SUMMARY OF THE INVENTION

The present invention includes and provides a method for the production of a soybean plant having an rhg1 SCN resistant allele comprising: (A) crossing a first soybean plant having an rhg1 SCN resistant allele with a second soybean plant having an rhg1 SCN sensitive allele to produce a segregating population; (B) screening the segregating population for a member having an rhg1 SCN resistant allele with a first nucleic acid molecule capable of specifically hybridizing to linkage group G, wherein the first nucleic acid molecule specifically hybridizes to a second nucleic acid molecule that is linked to the rhg1 SCN resistant allele; and, (C) selecting the member for further crossing and selection.

The present invention includes and provides a method of investigating an rhg1 haplotype of a soybean plant comprising: (A) isolating nucleic acid molecules from the soybean plant; (B) determining the nucleic acid sequence of an rhg1 allele or part thereof; and, (C) comparing the nucleic acid sequence of the rhg1 allele or part thereof to a reference nucleic acid sequence. The present invention includes and provides a method of introgressing SCN resistance or partial SCN resistance into a soybean plant comprising: performing marker assisted selection of the soybean plant with a nucleic acid marker, wherein the nucleic acid marker specifically hybridizes with a nucleic acid molecule having a first nucleic acid sequence that is physically linked to a second nucleic acid sequence that is located on linkage group G of soybean A3244, wherein the second nucleic acid sequence is within 500 kb of a third nucleic acid sequence which is capable of specifically hybridizing with the nucleic acid sequence of SEQ ID NO: 5, 6, complements thereof, or fragments thereof having at least 15 nucleotides; and, selecting the soybean plant based on the marker assisted selection.

The present invention includes and provides a method for the production of a soybean plant having an Rhg4 SCN resistant allele comprising: (A) crossing a first soybean plant having an Rhg4 SCN resistant allele with a second soybean plant having an Rhg4 SCN sensitive allele to produce a segregating population; (B) screening the segregating population for a member having an Rhg4 SCN resistant allele with a first nucleic acid molecule capable of specifically hybridizing to linkage group A2, wherein the first nucleic acid molecule specifically hybridizes to a second nucleic acid molecule linked to the Rhg4 SCN resistant allele; and, (C) selecting the member for further crossing and selection.

The present invention includes and provides a method of investigating an Rhg4 haplotype of a soybean plant comprising: (A) isolating nucleic acid molecules from the soybean plant; (B) determining the nucleic acid sequence of an Rhg4 allele or part thereof; and (C) comparing the nucleic acid sequence of the Rhg4 allele or part thereof to a reference nucleic acid sequence.

The present invention includes and provides a method of introgressing SCN resistance or partial SCN resistance into a soybean plant comprising: performing marker assisted selection of the soybean plant with a nucleic acid marker, wherein the nucleic acid marker specifically hybridizes with a nucleic acid molecule having a first nucleic acid sequence that is physically linked to a second nucleic acid sequence that is located on linkage group A2 of soybean A3244, wherein the second nucleic acid sequence is within 500 kb of a third nucleic acid sequence which specifically hybridizes with the nucleic acid sequence of SEQ ID NO: 7, complements thereof, or fragments thereof having at least 15 nucleotides; and, selecting the soybean plant based on the marker assisted selection.

The present invention includes and provides a substantially purified nucleic acid molecule comprising a nucleic acid sequence selected from the group consisting of SEQ ID NOs: 5, 6, 8–23, 28–43, complements thereof, and fragments of either.

The present invention includes and provides a substantially purified first nucleic acid molecule with nucleic acid sequence which specifically hybridizes to a second nucleic acid molecule having a nucleic acid sequence selected from the group consisting of a complement of SEQ ID NOs: 5, 6, 8–23, 28–43.

The present invention includes and provides a substantially purified nucleic acid molecule comprising a nucleic acid sequence selected from the group consisting of SEQ ID NOs: 7, 44–47, and 50–53, complements thereof, and fragments of either.

The present invention includes and provides a substantially purified first nucleic acid molecule with nucleic acid sequence which specifically hybridizes to a second nucleic acid molecule having a nucleic acid sequence selected from the group consisting of a complement of SEQ ID NOs: 50–53.

The present invention includes and provides a substantially purified protein or fragment thereof comprising an amino acid sequence selected from the group consisting of SEQ ID NOs: 1097, 1098, and 1100–1115 and fragments thereof.

The present invention includes and provides a substantially purified protein or fragment thereof comprising an amino acid sequence selected from the group consisting of SEQ ID NOs 1099, and 1116–1119 and fragments thereof.

The present invention includes and provides a transformed plant having a nucleic acid molecule which comprises: (A) an exogenous promoter region which functions in a plant cell to cause the production of a mRNA molecule; (B) a structural nucleic acid molecule encoding a protein or fragment thereof comprising an amino acid sequence selected from the group consisting of SEQ ID NOs: 1097, 1100, 1098, 1101, 1102–1115; and (C) a 3' non-translated sequence that functions in the plant cell to cause termination of transcription and addition of polyadenylated ribonucleotides to a 3' end of the mRNA molecule.

The present invention includes and provides a transformed plant having a nucleic acid molecule which comprises: (A) an exogenous promoter region which functions in a plant cell to cause the production of a mRNA molecule; (B) a structural nucleic acid molecule encoding a protein or fragment thereof comprising an amino acid sequence selected from the group consisting of SEQ ID NOs: 1099, 1116–1119; and (C) a 3' non-translated sequence that functions in the plant cell to cause termination of transcription and addition of polyadenylated ribonucleotides to a 3' end of the mRNA molecule.

The present invention includes and provides a transgenic seed having a nucleic acid molecule which comprises: (A) an exogenous promoter region which functions to cause the production of a mRNA molecule; (B) a structural nucleic acid molecule encoding a protein or fragment thereof comprising an amino acid sequence selected from the group consisting of SEQ ID NOs: 1097, 1100, 1098, 1101, 1102–1115; and (C) a 3' non-translated sequence that functions to cause termination of transcription and addition of polyadenylated ribonucleotides to a 3' end of the mRNA molecule.

The present invention includes and provides a transgenic seed having a nucleic acid molecule which comprises: (A) an exogenous promoter region which functions to cause the production of a mRNA molecule; (B) a structural nucleic acid molecule encoding a protein or fragment thereof comprising an amino acid sequence selected from the group consisting of SEQ ID NOs: 1099, 1116–1119; and (C) a 3' non-translated sequence that functions to cause termination of transcription and addition of polyadenylated ribonucleotides to a 3' end of the mRNA molecule.

DESCRIPTION OF THE FIGURES

FIG. 1 is an amino acid sequence alignment of the leucine rich repeat domain of rhg1.

FIG. 2 is an amino acid sequence alignment of the leucine rich repeat domain of Rhg4.

DESCRIPTION OF THE SEQUENCE LISTINGS

The following sequence listings form part of the present specification and are included to further demonstrate certain aspects of the present invention. The invention may be better understood by reference to one or more of these sequences in combination with the detailed description presented herein.

SEQ ID NOs: 1–7 and 1097–1099 all refer to sequences from the line A3244.

SEQ ID NO: 1 is sequence ID 515002_region_G2 from line A3244, and is adjacent to the contig containing rhg1.

SEQ ID NO: 2 is sequence ID 240017_region_G3 from line A3244, and contains the rhg1, v.1 four exon gene at coding coordinates 45163–45314, 45450–45509, 46941–48763, 48975–49573. The amino acid translation for SEQ ID NO: 2 is SEQ ID NO: 1097.

SEQ ID NO: 3 is sequence ID 240017_region_G3 from line A3244, and contains the rhg1, v.2 two exon gene at coding coordinates 46798–48763 and 48975–49573. The amino acid translation for SEQ ID NO: 3 is SEQ ID NO: 1098.

SEQ ID NO: 4 is sequence ID 318013_region_A3 from line A3244, contains the Rhg4 gene at coding coordinates 111805–113968 and 114684–115204, and has an amino acid translation of SEQ ID NO: 1099.

SEQ ID NO: 5 is sequence ID 240017_region_G3_8_mRNA, and comprises the two rhg1, v.2 exons from the coding sequence portion of SEQ ID NO: 3.

SEQ ID NO: 6 is sequence ID 240017_region_G3_8_cds, and comprises the four rhg1, v.1 exons from the coding sequence portion of SEQ ID NO: 2.

SEQ ID NO: 7 is sequence ID 318013_region_A3_17cds, and comprises the Rhg4 coding sequence portion from SEQ ID NO: 4.

SEQ ID NOs: 8–43 and 1100–1115 all refer to rhg1 sequences.

SEQ ID NO: 8 is sequence ID rhg1_A3244_amplicon from line A3244, contains four rhg1, v.1 exons at coding coordinates 113–264, 400–459, 1891–3713, and 3925–4523, and has an amino acid translation of SEQ ID NO: 1100 and 1097.

SEQ ID NO: 9 is sequence ID rhg1_A3244 amplicon, contains two rhg1, v.2 exons at coding coordinates 1748–3713 and 3925–4523 and has an amino acid translation of SEQ ID NO: 1101 and 1098.

SEQ ID NO: 10 is sequence ID rhg1_peking_amplicon from the line peking, contains four rhg1, v.1 exons at coding coordinates 113–264, 400–459, 1888–3710, and 3903–4501, and has an amino acid translation of SEQ ID NO: 1102.

SEQ ID NO: 11 is sequence ID rhg1_peking_amplicon, contains two rhg1, v.2 exons at coding coordinates 1745–3710 and 3903–4501, and has an amino acid translation of SEQ ID NO: 1103.

SEQ ID NO: 12 is sequence ID rhg1_toyosuzu_amplicon from the line toyosuzu, contains four rhg1, v.1 exons at coding coordinates 113–264, 400–459, 1890–3712, and 3924–4522, and has an amino acid translation of SEQ ID NO: 1104.

SEQ ID NO: 13 is sequence ID rhg1_toyosuzu_amplicon, contains two rhg1, v.2 exons at coding coordinates 1747–3712 and 3924–4522, and has an amino acid translation of SEQ ID NO: 1105.

SEQ ID NO: 14 is sequence ID rhg1_will_amplicon from the line will, contains four rhg1, v.1 exons at coding coordinates 113–264, 400–459, 1891–3713, and 3925–4523, and has an amino acid translation of SEQ ID NO: 1106.

SEQ ID NO: 15 is sequence ID rhg1_will_amplicon, contains two rhg1, v.2 exons at coding coordinates 1748–3713 and 3925–4523, and has an amino acid translation of SEQ ID NO: 1107.

SEQ ID NO: 16 is sequence ID rhg1_a2704_amplicon from the line A2704, contains four rhg1, v.1 exons at coding coordinates 113–264, 400–459, 1891–3713, and 3925–4523, and has an amino acid translation of SEQ ID NO: 1108.

SEQ ID NO: 17 is sequence ID rhg1_a2704_amplicon, contains two rhg1, v.2 exons at coding coordinates 1748–3713 and 3925–4523, and has an amino acid translation of SEQ ID NO: 1109.

SEQ ID NO: 18 is sequence ID rhg1_noir_amplicon from the line noir, contains four rhg1, v.1 exons at coding coordinates 113–264, 400–459, 1876–3698, and 3910–4508, and has an amino acid translation of SEQ ID NO: 1110.

SEQ ID NO: 19 is sequence ID rhg1_noir_amplicon, contains two rhg1, v.2 exons at coding coordinates 1733–3698 and 3910–4508, and has an amino acid translation of SEQ ID NO: 1111.

SEQ ID NO: 20 is sequence ID rhg1_lee_amplicon from the line lee, contains four rhg1, v.1 exons at coding coordinates 113–264, 400–459, 1876–3698, and 3910–4508, and has an amino acid translation of SEQ ID NO: 1112.

SEQ ID NO: 21 is sequence ID rhg1_lee_amplicon, contains two rhg1, v.2 exons at coding coordinates 1733–3698 and 3910–4508, and has an amino acid translation of SEQ ID NO: 1113.

SEQ ID NO: 22 is sequence ID rhg1_pi200499_amplicon from the line PI200499, contains four rhg1, v.1 exons at coding coordinates 113–264, 400–459, 1876–3698, and 3910–4508, and has an amino acid translation of SEQ ID NO: 1114.

SEQ ID NO: 23 is sequence ID rhg1_pi200499_amplicon, contains two rhg1, v.2 exons at coding coordinates 1733–3698 and 3910–4508, and has an amino acid translation of SEQ ID NO: 1115.

SEQ ID NO: 24 is sequence ID 240017_region_G3_forward_1, is a primer that hybridizes to coordinates 45051–45077 on contig 240017_region_G3 before the start codon, and can be used with SEQ ID NO: 25.

SEQ ID NO: 25 is sequence ID 240017_region_G3_reverse_1, is a primer that hybridizes to coordinates 47942–47918 on contig 240017 region G3, and can be used with SEQ ID NO: 24.

SEQ ID NO: 26 is sequence ID 240017_region_G3_forward_2, is a primer that hybridizes to coordinates 47808–47831 on contig 240017_region_G3, and can be used with SEQ ID NO: 27.

SEQ ID NO: 27 is sequence ID 240017_region_G3_reverse_2, is a primer that hybridizes to coordinates 49553–49531 of contig 240017_region_G3 prior to the stop codon, and can be used with SEQ ID NO: 26.

Primers given by SEQ ID NOs: 24–27 are used to create the amplicons of SEQ ID NOs: 8–23. The final 22 bases are added to the actual amplicons in order to simulate the rest of the gene to the stop codon, in order to allow complete translation.

SEQ ID NO: 28 is sequence ID rhg1_A3244_amplicon_cds, which is the coding sequence portion of SEQ ID NO: 8.

SEQ ID NO: 29 is sequence ID rhg1_peking_amplicon_cds, which is the coding sequence portion of SEQ ID NO: 10.

SEQ ID NO: 30 is sequence ID rhg1_toyosuzu_amplicon_cds, which is the coding sequence portion of SEQ ID NO: 12.

SEQ ID NO: 31 is sequence ID rhg1_will_amplicon_cds, which is the coding sequence portion of SEQ ID NO: 14.

SEQ ID NO: 32 is sequence ID rhg1_a2704_amplicon_cds, which is the coding sequence portion of SEQ ID NO: 16.

SEQ ID NO: 33 is sequence ID rhg1_noir_amplicon_cds, which is the coding sequence portion of SEQ ID NO: 18.

SEQ ID NO: 34 is sequence ID rhg1_lee_amplicon_cds, which is the coding sequence portion of SEQ ID NO: 20.

SEQ ID NO: 35 is sequence ID rhg1_pi200499_amplicon_cds, which is the coding sequence portion of SEQ ID NO: 22.

SEQ ID NO: 36 is sequence ID rhg1_A3244_amplicon_cds_2, which is the coding sequence portion of SEQ ID NO: 9.

SEQ ID NO: 37 is sequence ID rhg1_peking_amplicon_cds_2, which is the coding sequence portion of SEQ ID NO: 11.

SEQ ID NO: 38 is sequence ID rhg1_toyosuzu_amplicon_cds_2, which is the coding sequence portion of SEQ ID NO: 13.

SEQ ID NO: 39 is sequence ID rhg1_will_amplicon_cds_2, which is the coding sequence portion of SEQ ID NO: 15.

SEQ ID NO: 40 is sequence ID rhg1_a2704_amplicon_cds_2, which is the coding sequence portion of SEQ ID NO: 17.

SEQ ID NO: 41 is sequence ID rhg1_noir_amplicon_cds_2, which is the coding sequence portion of SEQ ID NO: 19.

SEQ ID NO: 42 is sequence ID rhg1_lee_amplicon_cds_2, which is the coding sequence portion of SEQ ID NO: 21.

SEQ ID NO: 43 is sequence ID rhg1_pi200499_amplicon_cds_2, which is the coding sequence portion of SEQ ID NO: 23.

SEQ ID NOs: 44–53 and 1116–1119 all refer to Rhg4 sequences

SEQ ID NO: 44 is sequence ID rhg4_a3244_amplicon from the line A3244, contains Rhg4 at coding coordinates 79–2242 and 2958–3478, is made using SEQ ID NOs: 48 and 49, and has an amino acid translation of SEQ ID NO: 1116 and 1099.

SEQ ID NO: 45 is sequence ID rhg4_Minsoy_amplicon from the line Minsoy, contains Rhg4 at coding coordinates 79–2242 and 2958–3478, is made using SEQ ID NOs: 48 and 49, and has an amino acid translation of SEQ ID NO: 1117.

SEQ ID NO: 46 is sequence ID rhg4_Jack_amplicon from the line Jack, contains Rhg4 at coding coordinates 79–2242 and 2958–3478, is made using SEQ ID NO: 48 and 49, and has an amino acid translation of SEQ ID NO: 1118.

SEQ ID NO: 47 is sequence ID rhg4_peking_amplicon from the line Peking, contains Rhg4 at coding coordinates 79–2242 and 2958–3478, is made using SEQ ID NOs: 48 and 49, and has an amino acid translation of SEQ ID NO: 1119.

SEQ ID NO: 48 is sequence ID 318013_region_A3_forward, hybridizes to coordinates 111727–111756 of contig 318013_region_A3, and is a primer used with SEQ ID NO: 49 to create Rhg4 amplicons.

SEQ ID NO: 49 is sequence ID 318013_region_A3_reverse, hybridizes to coordinates 115206–115177 of contig 318013_region_A3, and is a primer used with SEQ ID NO: 48 to create Rhg4 amplicons.

SEQ ID NO: 50 is sequence ID rhg4_A3244_amplicon_cds, which is the coding sequence portion of SEQ ID NO: 44.

SEQ ID NO: 51 is sequence ID rhg4_Minsoy_amplicon_cds, which is the coding sequence portion of SEQ ID NO: 45.

SEQ ID NO: 52 is sequence ID rhg4_Jack_amplicon_cds, which is the coding sequence portion of SEQ ID NO: 46.

SEQ ID NO: 53 is sequence ID rhg4_peking_amplicon_cds, which is the coding sequence portion of SEQ ID NO: 47.

SEQ ID NO: 1120 is sequence ID consensusLRR, which is a consensus sequence for the LRR repeats shown in FIGS. 1 and 2.

SEQ ID NO: 1121 is sequence ID rhg1LRR, which is the amino acid sequence of the LRR domain shown in FIG. 1.

SEQ ID NO: 1122 is sequence ID Rhg4LRR, which is the amino acid sequence of the LRR domain shown in FIG. 2.

SEQ ID NO: 1123 is sequence ID 240017_region_G3_forward_1_b, which is an alternate primer that hybridizes to coordinates 45046–45072 on contig 240017_region_G3 before the start codon, and which can be used with SEQ ID NO: 25.

Table 1 below provides further information on the sequences described herein.

In table 1, for all rows, "Seq Num" refers to the corresponding SEQ ID NO in the sequence listing.

For rows with SEQ ID NOs: 1–53 and 1120–1123 "Seq ID" refers to the name of the SEQ ID NO given in the "Seq Num" column.

For rows with SEQ ID NOs: 2–4,8–23, and 44–47 "Coding Sequence" refers to the coordinates of the coding portion of the SEQ ID NO given in the "Seq Num" column, and "AA" refers to the SEQ ID NO that is the amino acid translation of the SEQ ID NO given in the "Seq Num" column.

For rows with SEQ ID NOs: 24–27 and 1123, "Primer location on 240017_region_G3" refers to the coordinates of the 240017_region_G3 contig to which the SEQ ID NO given in the "Seq Num" column hybridizes.

For rows with SEQ ID NOs: 48 and 49, "Primer location on 318013region_A3" refers to the coordinates of the 318013_region_A3 contig to which the SEQ ID NO given in the "Seq Num" column hybridizes.

For rows with SEQ ID NOs: 54–400, "Seq ID" refers to the names of amplicon sequences. Within the Seq ID is the "__" (double length underscore) symbol. The name before this symbol refers to the name of the contig in which the amplicon is found, and the numbers after this symbol refer to the nucleotide location of the SSR on the contig.

For rows with SEQ ID NOs: 401–1096, "Seq ID" refers to the names of primer sequences used in PCR to generate the amplicon sequences in table 1. For these rows, the "Seq ID" name contains the same name as the amplicon that is generated by the pair of primers of which the SEQ ID NO referred to in the first column is a member. The "Seq ID" name also contains either "Forward" or "Reverse," which indicates the orientation of the primer. For these sequences, "location of primer on contig start" and "location of primer on contig end" refer, respectively, to the first and last base number of the contig on which the primer aligns.

TABLE 1

| Seq Num | Seq ID | Coding Sequence | AA No. |
|---|---|---|---|
| 1 | 515O02_region_G2 | | |
| 2 | 240O17_region_G3 | 45163–45314, 45450–45509, 46941–48763, 48975–49573 | 1097 |
| 3 | 240O17_region_G3 | 46798–48763, 48975–49573 | 1098 |
| 4 | 318O13_region_A3 | 111805–113968, 114684–115204 | 1099 |
| 5 | 240O17_region_G3_8_mRNA | | |
| 6 | 240O17_region_G3_8_cds | | |
| 7 | 318O13_region_A3_17_cds | | |
| 8 | rhg1_A3244_amplicon | 113–264, 400–459, 1891–3713, 3925–4523 | 1100 |
| 9 | rhg1_A3244_amplicon | 1748–3713, 3925–4523 | 1101 |
| 10 | rhg1_peking_amplicon | 113–264, 400–459, 1888–3710, 3903–4501 | 1102 |
| 11 | rhg1_peking_amplicon | 1745–3710, 3903–4501 | 1103 |
| 12 | rhg1_toyosuzu_amplicon | 113–264, 400–459, 1890–3712, 3924–4522 | 1104 |
| 13 | rhg1_toyosuzu_amplicon | 1747–3712, 3924–4522 | 1105 |
| 14 | rhg1_will_amplicon | 113–264, 400–459, 1891–3713, 3925–4523 | 1106 |
| 15 | rhg1_will_amplicon | 1748–3713, 3925–4523 | 1107 |
| 16 | rhg1_a2704_amplicon | 113–264, 400–459, 1891–3713, 3925–4523 | 1108 |
| 17 | rhg1_a2704_amplicon | 1748–3713, 3925–4523 | 1109 |
| 18 | rhg1_noir_amplicon | 113–264, 400–459, 1876–3698, 3910–4508 | 1110 |
| 19 | rhg1_noir_amplicon | 1733–3698, 3910–4508 | 1111 |
| 20 | rhg1_lee_amplicon | 113–264, 400–459, 1876–3698, 3910–4508 | 1112 |
| 21 | rhg1_lee_amplicon | 1733–3698, 3910–4508 | 1113 |
| 22 | rhg1_pi200499_amplicon | 113–264, 400–459, 1876–3698, 3910–4508 | 1114 |
| 23 | rhg1_pi200499_amplicon | 1733–3698, 3910–4508 | 1115 |
| | | Primer location on 240O17_region_G3 | |
| 24 | 240O17_region_G3_forward_1 | 45051–45077 | |
| 25 | 240O17_region_G3_reverse_1 | 47942–47918 | |
| 26 | 240O17_region_G3_forward_2 | 47808–47831 | |
| 27 | 240O17_region_G3_reverse_2 | 49553–49531 | |
| 28 | rhg1_A3244_amplicon_cds | | |
| 29 | rhg1_peking_amplicon_cds | | |
| 30 | rhg1_toyosuzu_amplicon_cds | | |
| 31 | rhg1_will_amplicon_cds | | |
| 32 | rhg1_a2704_amplicon_cds | | |
| 33 | rhg1_noir_amplicon_cds | | |
| 34 | rhg1_lee_amplicon_cds | | |
| 35 | rhg1_pi200499_amplicon_cds | | |
| 36 | rhg1_A3244_amplicon_cds_2 | | |
| 37 | rhg1_peking_amplicon_cds_2 | | |
| 38 | rhg1_toyosuzu_amplicon_cds_2 | | |
| 39 | rhg1_will_amplicon_cds_2 | | |
| 40 | rhg1_a2704_amplicon_cds_2 | | |
| 41 | rhg1_noir_amplicon_cds_2 | | |
| 42 | rhg1_lee_amplicon_cds_2 | | |
| 43 | rhg1_pi200499_amplicon_cds_2 | | |
| | | Coding Sequence | |
| 44 | rhg4_a3244_amplicon | 79–2242, 2958–3478 | 1116 |
| 45 | rhg4_Minsoy_amplicon | 79–2242, 2958–3478 | 1117 |
| 46 | rhg4_Jack_amplicon | 79–2242, 2958–3478 | 1118 |
| 47 | rhg4_peking_amplicon | 79–2242, 2958–3478 | 1119 |
| | | Primer location on 318O13_region_A3 | |
| 48 | 318O13_region_A3_forward | 111727–111756 | |
| 49 | 318O13_region_A3_reverse | 115206–115177 | |
| 50 | rhg4_A3244_amplicon_cds | | |
| 51 | rhg4_Minsoy_amplicon_cds | | |
| 52 | rhg4_Jack_amplicon_cds | | |
| 53 | rhg4_peking_amplicon_cds | | |
| 54 | 240O17_region_G3_289711_11 | | |
| 55 | 240O17_region_G3_236585_14 | | |
| 56 | 240O17_region_G3_168772_13 | | |
| 57 | 240O17_region_G3_332420_21 | | |
| 58 | 240O17_region_G3_228126_18 | | |
| 59 | 240O17_region_G3_139723_11 | | |
| 60 | 240O17_region_G3_280585_14 | | |
| 61 | 240O17_region_G3_70509_14 | | |
| 62 | 240O17_region_G3_50537_17 | | |
| 63 | 240O17_region_G3_231556_17 | | |
| 64 | 240O17_region_G3_117057_11 | | |
| 65 | 240O17_region_G3_23092_13 | | |
| 66 | 240O17_region_G3_297741_14 | | |
| 67 | 240O17_region_G3_206502_14 | | |
| 68 | 240O17_region_G3_221223_13 | | |
| 69 | 240O17_region_G3_169084_14 | | |

TABLE 1-continued

| Seq Num | Seq ID |
|---|---|
| 70 | 240O17_region_G3_94891_14 |
| 71 | 240O17_region_G3_281852_61 |
| 72 | 240O17_region_G3_46583_12 |
| 73 | 240O17_region_G3_306835_13 |
| 74 | 240O17_region_G3_85471_12 |
| 75 | 240O17_region_G3_257208_12 |
| 76 | 240O17_region_G3_150390_17 |
| 77 | 240O17_region_G3_34697_75 |
| 78 | 240O17_region_G3_150374_13 |
| 79 | 240O17_region_G3_40513_22 |
| 80 | 240O17_region_G3_268602_14 |
| 81 | 240O17_region_G3_25357_13 |
| 82 | 240O17_region_G3_137548_13 |
| 83 | 240O17_region_G3_139131_13 |
| 84 | 240O17_region_G3_203855_12 |
| 85 | 240O17_region_G3_199049_15 |
| 86 | 240O17_region_G3_320907_12 |
| 87 | 240O17_region_G3_16407_17 |
| 88 | 240O17_region_G3_206516_17 |
| 89 | 240O17_region_G3_264495_13 |
| 90 | 240O17_region_G3_156785_13 |
| 91 | 240O17_region_G3_187129_12 |
| 92 | 240O17_region_G3_214106_13 |
| 93 | 240O17_region_G3_149013_12 |
| 94 | 240O17_region_G3_326352_16 |
| 95 | 240O17_region_G3_278962_12 |
| 96 | 240O17_region_G3_256930_13 |
| 97 | 240O17_region_G3_29646_14 |
| 98 | 240O17_region_G3_29618_13 |
| 99 | 240O17_region_G3_108561_14 |
| 100 | 240O17_region_G3_143975_14 |
| 101 | 240O17_region_G3_108431_20 |
| 102 | 240O17_region_G3_281764_11 |
| 103 | 240O17_region_G3_130058_15 |
| 104 | 240O17_region_G3_310590_52 |
| 105 | 240O17_region_G3_313405_14 |
| 106 | 240O17_region_G3_302190_13 |
| 107 | 240O17_region_G3_225343_17 |
| 108 | 240O17_region_G3_208823_14 |
| 109 | 240O17_region_G3_74285_11 |
| 110 | 240O17_region_G3_109052_16 |
| 111 | 240O17_region_G3_6395_12 |
| 112 | 240O17_region_G3_244905_16 |
| 113 | 240O17_region_G3_244956_13 |
| 114 | 240O17_region_G3_117220_13 |
| 115 | 240O17_region_G3_134707_14 |
| 116 | 240O17_region_G3_35078_13 |
| 117 | 240O17_region_G3_210506_16 |
| 118 | 240O17_region_G3_116961_26 |
| 119 | 240O17_region_G3_51073_13 |
| 120 | 240O17_region_G3_55291_15 |
| 121 | 240O17_region_G3_229651_18 |
| 122 | 240O17_region_G3_303308_19 |
| 123 | 240O17_region_G3_168373_20 |
| 124 | 240O17_region_G3_253333_17 |
| 125 | 240O17_region_G3_5791_13 |
| 126 | 240O17_region_G3_206841_19 |
| 127 | 240O17_region_G3_202827_12 |
| 128 | 240O17_region_G3_322656_13 |
| 129 | 240O17_region_G3_111841_14 |
| 130 | 240O17_region_G3_192719_13 |
| 131 | 240O17_region_G3_195630_17 |
| 132 | 240O17_region_G3_69999_13 |
| 133 | 240O17_region_G3_11176_13 |
| 134 | 240O17_region_G3_228643_13 |
| 135 | 240O17_region_G3_88478_19 |
| 136 | 240O17_region_G3_108950_13 |
| 137 | 240O17_region_G3_121054_14 |
| 138 | 240O17_region_G3_188337_14 |
| 139 | 240O17_region_G3_255944_21 |
| 140 | 240O17_region_G3_219518_14 |
| 141 | 240O17_region_G3_235601_15 |
| 142 | 240O17_region_G3_301529_13 |
| 143 | 240O17_region_G3_94795_14 |
| 144 | 240O17_region_G3_46703_23 |
| 145 | 240O17_region_G3_59616_14 |
| 146 | 240O17_region_G3_296933_15 |

TABLE 1-continued

| Seq Num | Seq ID |
|---|---|
| 147 | 240O17_region_G3_192428_17 |
| 148 | 240O17_region_G3_191490_14 |
| 149 | 240O17_region_G3_201115_11 |
| 150 | 240O17_region_G3_72882_15 |
| 151 | 240O17_region_G3_69514_13 |
| 152 | 240O17_region_G3_37699_47 |
| 153 | 240O17_region_G3_11301_29 |
| 154 | 240O17_region_G3_141875_12 |
| 155 | 240O17_region_G3_98090_18 |
| 156 | 240O17_region_G3_43298_35 |
| 157 | 240O17_region_G3_262094_11 |
| 158 | 240O17_region_G3_262079_15 |
| 159 | 240O17_region_G3_59090_12 |
| 160 | 240O17_region_G3_245723_13 |
| 161 | 240O17_region_G3_194628_54 |
| 162 | 240O17_region_G3_4566_16 |
| 163 | 240O17_region_G3_96209_14 |
| 164 | 240O17_region_G3_248715_17 |
| 165 | 240O17_region_G3_71410_40 |
| 166 | 240O17_region_G3_226519_13 |
| 167 | 240O17_region_G3_11282_19 |
| 168 | 240O17_region_G3_170504_12 |
| 169 | 240O17_region_G3_40864_14 |
| 170 | 240O17_region_G3_13529_14 |
| 171 | 240O17_region_G3_22858_14 |
| 172 | 240O17_region_G3_309211_13 |
| 173 | 240O17_region_G3_55568_26 |
| 174 | 240O17_region_G3_73238_16 |
| 175 | 240O17_region_G3_52488_19 |
| 176 | 318O13_region_A3_471518_14 |
| 177 | 318O13_region_A3_231599_23 |
| 178 | 318O13_region_A3_375912_13 |
| 179 | 318O13_region_A3_180013_12 |
| 180 | 318O13_region_A3_171606_14 |
| 181 | 318O13_region_A3_416256_13 |
| 182 | 318O13_region_A3_231395_15 |
| 183 | 318O13_region_A3_5502_47 |
| 184 | 318O13_region_A3_93061_14 |
| 185 | 318O13_region_A3_111684_19 |
| 186 | 318O13_region_A3_69328_14 |
| 187 | 318O13_region_A3_36529_17 |
| 188 | 318O13_region_A3_139128_12 |
| 189 | 318O13_region_A3_495674_13 |
| 190 | 318O13_region_A3_187577_13 |
| 191 | 318O13_region_A3_453036_14 |
| 192 | 318O13_region_A3_374041_13 |
| 193 | 318O13_region_A3_3412_11 |
| 194 | 318O13_region_A3_276495_28 |
| 195 | 318O13_region_A3_151839_17 |
| 196 | 318O13_region_A3_292912_12 |
| 197 | 318O13_region_A3_104560_12 |
| 198 | 318O13_region_A3_65193_11 |
| 199 | 318O13_region_A3_110573_70 |
| 200 | 318O13_region_A3_65117_12 |
| 201 | 318O13_region_A3_490837_16 |
| 202 | 318O13_region_A3_107448_11 |
| 203 | 318O13_region_A3_331_23 |
| 204 | 318O13_region_A3_193470_13 |
| 205 | 318O13_region_A3_183305_14 |
| 206 | 318O13_region_A3_55050_14 |
| 207 | 318O13_region_A3_224693_21 |
| 208 | 318O13_region_A3_207216_12 |
| 209 | 318O13_region_A3_4654_22 |
| 210 | 318O13_region_A3_408959_13 |
| 211 | 318O13_region_A3_132288_22 |
| 212 | 318O13_region_A3_292822_20 |
| 213 | 318O13_region_A3_311076_12 |
| 214 | 318O13_region_A3_509623_13 |
| 215 | 318O13_region_A3_190404_14 |
| 216 | 318O13_region_A3_164916_15 |
| 217 | 318O13_region_A3_21028_13 |
| 218 | 318O13_region_A3_208012_17 |
| 219 | 318O13_region_A3_484089_14 |
| 220 | 318O13_region_A3_332780_17 |
| 221 | 318O13_region_A3_480137_37 |
| 222 | 318O13_region_A3_441056_14 |
| 223 | 318O13_region_A3_77486_11 |

TABLE 1-continued

| Seq Num | Seq ID |
|---|---|
| 224 | 318O13_region_A3_272468_11 |
| 225 | 318O13_region_A3_425319_17 |
| 226 | 318O13_region_A3_413879_31 |
| 227 | 318O13_region_A3_80477_64 |
| 228 | 318O13_region_A3_277272_50 |
| 229 | 318O13_region_A3_509642_13 |
| 230 | 318O13_region_A3_321771_14 |
| 231 | 318O13_region_A3_26788_12 |
| 232 | 318O13_region_A3_262706_16 |
| 233 | 318O13_region_A3_243928_16 |
| 234 | 318O13_region_A3_23246_14 |
| 235 | 318O13_region_A3_165406_12 |
| 236 | 318O13_region_A3_486294_14 |
| 237 | 318O13_region_A3_46754_12 |
| 238 | 318O13_region_A3_381116_15 |
| 239 | 318O13_region_A3_350369_11 |
| 240 | 318O13_region_A3_138841_13 |
| 241 | 318O13_region_A3_12158_14 |
| 242 | 318O13_region_A3_315368_13 |
| 243 | 318O13_region_A3_307549_13 |
| 244 | 318O13_region_A3_159857_14 |
| 245 | 318O13_region_A3_140551_15 |
| 246 | 318O13_region_A3_279869_11 |
| 247 | 318O13_region_A3_78292_35 |
| 248 | 318O13_region_A3_185019_12 |
| 249 | 318O13_region_A3_409164_13 |
| 250 | 318O13_region_A3_75392_14 |
| 251 | 318O13_region_A3_231320_12 |
| 252 | 318O13_region_A3_381102_14 |
| 253 | 318O13_region_A3_491826_15 |
| 254 | 318O13_region_A3_56365_21 |
| 255 | 318O13_region_A3_372628_15 |
| 256 | 318O13_region_A3_302609_11 |
| 257 | 318O13_region_A3_341804_11 |
| 258 | 318O13_region_A3_217037_11 |
| 259 | 318O13_region_A3_264929_68 |
| 260 | 318O13_region_A3_55499_12 |
| 261 | 318O13_region_A3_295634_14 |
| 262 | 318O13_region_A3_269358_15 |
| 263 | 318O13_region_A3_457009_24 |
| 264 | 318O13_region_A3_176598_14 |
| 265 | 318O13_region_A3_278266_12 |
| 266 | 318O13_region_A3_391810_12 |
| 267 | 318O13_region_A3_269485_15 |
| 268 | 318O13_region_A3_359247_17 |
| 269 | 318O13_region_A3_315094_13 |
| 270 | 318O13_region_A3_307823_13 |
| 271 | 318O13_region_A3_248588_15 |
| 272 | 318O13_region_A3_252426_85 |
| 273 | 318O13_region_A3_513314_16 |
| 274 | 318O13_region_A3_68183_14 |
| 275 | 318O13_region_A3_471191_13 |
| 276 | 318O13_region_A3_163547_18 |
| 277 | 318O13_region_A3_417867_15 |
| 278 | 318O13_region_A3_332465_14 |
| 279 | 318O13_region_A3_207697_14 |
| 280 | 318O13_region_A3_277229_43 |
| 281 | 318O13_region_A3_36366_11 |
| 282 | 318O13_region_A3_91970_12 |
| 283 | 318O13_region_A3_211533_11 |
| 284 | 318O13_region_A3_336301_11 |
| 285 | 318O13_region_A3_441603_14 |
| 286 | 318O13_region_A3_468354_15 |
| 287 | 318O13_region_A3_188983_18 |
| 288 | 318O13_region_A3_115502_17 |
| 289 | 318O13_region_A3_163006_13 |
| 290 | 318O13_region_A3_119283_14 |
| 291 | 318O13_region_A3_491126_11 |
| 292 | 318O13_region_A3_99512_21 |
| 293 | 318O13_region_A3_280291_17 |
| 294 | 318O13_region_A3_138443_19 |
| 295 | 318O13_region_A3_115973_14 |
| 296 | 318O13_region_A3_329977_14 |
| 297 | 318O13_region_A3_205203_14 |
| 298 | 318O13_region_A3_153114_12 |
| 299 | 318O13_region_A3_34581_13 |
| 300 | 318O13_region_A3_292577_19 |

TABLE 1-continued

| Seq Num | Seq ID |
|---|---|
| 301 | 318O13_region_A3_445391_20 |
| 302 | 318O13_region_A3_350540_17 |
| 303 | 318O13_region_A3_453879_15 |
| 304 | 318O13_region_A3_201246_13 |
| 305 | 318O13_region_A3_326020_13 |
| 306 | 318O13_region_A3_503801_14 |
| 307 | 318O13_region_A3_302400_52 |
| 308 | 318O13_region_A3_448857_15 |
| 309 | 318O13_region_A3_48364_14 |
| 310 | 318O13_region_A3_251804_48 |
| 311 | 318O13_region_A3_382583_13 |
| 312 | 318O13_region_A3_124737_14 |
| 313 | 318O13_region_A3_124766_13 |
| 314 | 318O13_region_A3_461351_16 |
| 315 | 318O13_region_A3_64953_19 |
| 316 | 318O13_region_A3_366586_13 |
| 317 | 318O13_region_A3_46190_15 |
| 318 | 318O13_region_A3_81016_11 |
| 319 | 318O13_region_A3_134426_14 |
| 320 | 318O13_region_A3_292724_14 |
| 321 | 318O13_region_A3_187096_17 |
| 322 | 318O13_region_A3_381693_13 |
| 323 | 318O13_region_A3_361286_33 |
| 324 | 318O13_region_A3_482668_14 |
| 325 | 318O13_region_A3_128002_12 |
| 326 | 318O13_region_A3_499270_14 |
| 327 | 318O13_region_A3_231650_12 |
| 328 | 318O13_region_A3_199851_13 |
| 329 | 318O13_region_A3_324629_13 |
| 330 | 318O13_region_A3_374190_19 |
| 331 | 318O13_region_A3_460603_13 |
| 332 | 318O13_region_A3_108681_14 |
| 333 | 318O13_region_A3_459791_47 |
| 334 | 318O13_region_A3_4257_20 |
| 335 | 318O13_region_A3_238810_14 |
| 336 | 318O13_region_A3_245817_14 |
| 337 | 318O13_region_A3_245956_14 |
| 338 | 318O13_region_A3_74148_14 |
| 339 | 318O13_region_A3_74089_15 |
| 340 | 318O13_region_A3_241686_12 |
| 341 | 318O13_region_A3_47476_12 |
| 342 | 318O13_region_A3_164550_12 |
| 343 | 318O13_region_A3_101255_15 |
| 344 | 515O02_region_G2_16189_11 |
| 345 | 515O02_region_G2_71925_13 |
| 346 | 515O02_region_G2_4707_12 |
| 347 | 515O02_region_G2_118904_18 |
| 348 | 515O02_region_G2_13655_17 |
| 349 | 515O02_region_G2_53900_13 |
| 350 | 515O02_region_G2_8079_14 |
| 351 | 515O02_region_G2_9969_28 |
| 352 | 515O02_region_G2_72308_77 |
| 353 | 515O02_region_G2_99475_19 |
| 354 | 515O02_region_G2_118615_18 |
| 355 | 515O02_region_G2_119001_46 |
| 356 | 515O02_region_G2_118958_43 |
| 357 | 515O02_region_G2_17197_13 |
| 358 | 515O02_region_G2_105163_29 |
| 359 | 515O02_region_G2_111335_13 |
| 360 | 515O02_region_G2_106396_13 |
| 361 | 515O02_region_G2_59229_17 |
| 362 | 515O02_region_G2_73795_20 |
| 363 | 515O02_region_G2_85664_20 |
| 364 | 515O02_region_G2_36921_17 |
| 365 | 515O02_region_G2_124150_19 |
| 366 | 515O02_region_G2_5089_14 |
| 367 | 515O02_region_G2_58221_15 |
| 368 | 515O02_region_G2_96139_14 |
| 369 | 515O02_region_G2_70595_13 |
| 370 | 515O02_region_G2_4340_15 |
| 371 | 515O02_region_G2_90417_11 |
| 372 | 515O02_region_G2_49711_17 |
| 373 | 515O02_region_G2_63053_13 |
| 374 | 515O02_region_G2_63076_14 |
| 375 | 515O02_region_G2_44442_12 |
| 376 | 515O02_region_G2_44422_19 |
| 377 | 515O02_region_G2_44158_19 |

TABLE 1-continued

| Seq Num | Seq ID | location of primer on contig start | location of primer on contig end |
|---|---|---|---|
| 378 | 515O02_region_G2_44141_17 | | |
| 379 | 515O02_region_G2_90762_17 | | |
| 380 | 515O02_region_G2_106241_14 | | |
| 381 | 515O02_region_G2_109676_12 | | |
| 382 | 515O02_region_G2_86242_14 | | |
| 383 | 515O02_region_G2_83109_12 | | |
| 384 | 515O02_region_G2_10461_15 | | |
| 385 | 515O02_region_G2_67608_15 | | |
| 386 | 515O02_region_G2_63275_46 | | |
| 387 | 515O02_region_G2_62405_14 | | |
| 388 | 515O02_region_G2_33563_12 | | |
| 389 | 515O02_region_G2_33146_14 | | |
| 390 | 515O02_region_G2_102179_29 | | |
| 391 | 515O02_region_G2_2646_15 | | |
| 392 | 515O02_region_G2_76652_24 | | |
| 393 | 515O02_region_G2_66280_14 | | |
| 394 | 515O02_region_G2_54768_13 | | |
| 395 | 515O02_region_G2_62580_14 | | |
| 396 | 515O02_region_G2_34598_55 | | |
| 397 | 515O02_region_G2_77680_13 | | |
| 398 | 515O02_region_G2_77693_12 | | |
| 399 | 515O02_region_G2_97392_14 | | |
| 400 | 515O02_region_G2_97359_15 | | |
| 401 | 240O17_region_G3_289711_11_Forward_Primer | 289637 | 289661 |
| 402 | 240O17_region_G3_289711_11_Reverse_Primer | 289756 | 289732 |
| 403 | 240O17_region_G3_236585_14_Forward_Primer | 236511 | 236535 |
| 404 | 240O17_region_G3_236585_14_Reverse_Primer | 236638 | 236614 |
| 405 | 240O17_region_G3_168772_13_Forward_Primer | 168683 | 168707 |
| 406 | 240O17_region_G3_168772_13_Reverse_Primer | 168811 | 168786 |
| 407 | 240O17_region_G3_332420_21_Forward_Primer | 332375 | 332399 |
| 408 | 240O17_region_G3_332420_21_Reverse_Primer | 332505 | 332481 |
| 409 | 240O17_region_G3_228126_18_Forward_Primer | 228048 | 228072 |
| 410 | 240O17_region_G3_228126_18_Reverse_Primer | 228182 | 228158 |
| 411 | 240O17_region_G3_139723_11_Forward_Primer | 139666 | 139690 |
| 412 | 240O17_region_G3_139723_11_Reverse_Primer | 139802 | 139778 |
| 413 | 240O17_region_G3_280585_14_Forward_Primer | 280524 | 280550 |
| 414 | 240O17_region_G3_280585_14_Reverse_Primer | 280661 | 280637 |
| 415 | 240O17_region_G3_70509_14_Forward_Primer | 70478 | 70502 |
| 416 | 240O17_region_G3_70509_14_Reverse_Primer | 70616 | 70592 |
| 417 | 240O17_region_G3_50537_17_Forward_Primer | 50455 | 50479 |
| 418 | 240O17_region_G3_50537_17_Reverse_Primer | 50593 | 50569 |
| 419 | 240O17_region_G3_231556_17_Forward_Primer | 231468 | 231492 |
| 420 | 240O17_region_G3_231556_17_Reverse_Primer | 231606 | 231582 |
| 421 | 240O17_region_G3_117057_11_Forward_Primer | 117029 | 117053 |
| 422 | 240O17_region_G3_117057_11_Reverse_Primer | 117169 | 117145 |
| 423 | 240O17_region_G3_23092_13_Forward_Primer | 23010 | 23034 |
| 424 | 240O17_region_G3_23092_13_Reverse_Primer | 23151 | 23127 |
| 425 | 240O17_region_G3_297741_14_Forward_Primer | 297680 | 297704 |
| 426 | 240O17_region_G3_297741_14_Reverse_Primer | 297823 | 297799 |
| 427 | 240O17_region_G3_206502_14_Forward_Primer | 206456 | 206480 |
| 428 | 240O17_region_G3_206502_14_Reverse_Primer | 206600 | 206581 |
| 429 | 240O17_region_G3_221223_13_Forward_Primer | 221134 | 221158 |
| 430 | 240O17_region_G3_221223_13_Reverse_Primer | 221278 | 221254 |
| 431 | 240O17_region_G3_169084_14_Forward_Primer | 169051 | 169075 |
| 432 | 240O17_region_G3_169084_14_Reverse_Primer | 169196 | 169173 |
| 433 | 240O17_region_G3_94891_14_Forward_Primer | 94784 | 94808 |
| 434 | 240O17_region_G3_94891_14_Reverse_Primer | 94929 | 94905 |
| 435 | 240O17_region_G3_7439_12_Forward_Primer | 7397 | 7421 |
| 436 | 240O17_region_G3_7439_12_Reverse_Primer | 7542 | 7518 |
| 437 | 240O17_region_G3_281852_61_Forward_Primer | 281797 | 281821 |
| 438 | 240O17_region_G3_281852_61_Reverse_Primer | 281943 | 281919 |
| 439 | 240O17_region_G3_46583_12_Forward_Primer | 46554 | 46578 |
| 440 | 240O17_region_G3_46583_12_Reverse_Primer | 46700 | 46676 |
| 441 | 240O17_region_G3_306835_13_Forward_Primer | 306727 | 306751 |
| 442 | 240O17_region_G3_306835_13_Reverse_Primer | 306874 | 306849 |
| 443 | 240O17_region_G3_85471_12_Forward_Primer | 85359 | 85383 |
| 444 | 240O17_region_G3_85471_12_Reverse_Primer | 85507 | 85483 |
| 445 | 240O17_region_G3_257208_12_Forward_Primer | 257129 | 257153 |
| 446 | 240O17_region_G3_257208_12_Reverse_Primer | 257278 | 257254 |
| 447 | 240O17_region_G3_150390_17_Forward_Primer | 150327 | 150351 |
| 448 | 240O17_region_G3_150390_17_Reverse_Primer | 150476 | 150452 |
| 449 | 240O17_region_G3_34697_75_Forward_Primer | 34662 | 34685 |
| 450 | 240O17_region_G3_34697_75_Reverse_Primer | 34811 | 34787 |
| 451 | 240O17_region_G3_150374_13_Forward_Primer | 150327 | 150351 |

TABLE 1-continued

| Seq Num | Seq ID | | |
|---|---|---|---|
| 452 | 240O17_region_G3_150374_13_Reverse_Primer | 150476 | 150452 |
| 453 | 240O17_region_G3_40513_22_Forward_Primer | 40422 | 40446 |
| 454 | 240O17_region_G3_40513_22_Reverse_Primer | 40572 | 40548 |
| 455 | 240O17_region_G3_268602_14_Forward_Primer | 268555 | 268579 |
| 456 | 240O17_region_G3_268602_14_Reverse_Primer | 268705 | 268681 |
| 457 | 240O17_region_G3_25357_13_Forward_Primer | 25271 | 25295 |
| 458 | 240O17_region_G3_25357_13_Reverse_Primer | 25422 | 25402 |
| 459 | 240O17_region_G3_137548_13_Forward_Primer | 139088 | 139111 |
| 459 | 240O17_region_G3_137548_13_Forward_Primer | 137505 | 137528 |
| 460 | 240O17_region_G3_137548_13_Reverse_Primer | 139239 | 139215 |
| 460 | 240O17_region_G3_137548_13_Reverse_Primer | 137656 | 137632 |
| 461 | 240O17_region_G3_139131_13_Forward_Primer | 139088 | 139111 |
| 462 | 240O17_region_G3_139131_13_Reverse_Primer | 139239 | 139215 |
| 463 | 240O17_region_G3_203855_12_Forward_Primer | 203749 | 203773 |
| 464 | 240O17_region_G3_203855_12_Reverse_Primer | 203901 | 203877 |
| 465 | 240O17_region_G3_199049_15_Forward_Primer | 199008 | 199033 |
| 466 | 240O17_region_G3_199049_15_Reverse_Primer | 199160 | 199136 |
| 467 | 240O17_region_G3_320907_12_Forward_Primer | 320885 | 320906 |
| 468 | 240O17_region_G3_320907_12_Reverse_Primer | 321038 | 321015 |
| 469 | 240O17_region_G3_16407_17_Forward_Primer | 16330 | 16354 |
| 470 | 240O17_region_G3_16407_17_Reverse_Primer | 16483 | 16459 |
| 471 | 240O17_region_G3_206516_17_Forward_Primer | 206482 | 206506 |
| 472 | 240O17_region_G3_206516_17_Reverse_Primer | 206635 | 206616 |
| 473 | 240O17_region_G3_264495_13_Forward_Primer | 264423 | 264447 |
| 474 | 240O17_region_G3_264495_13_Reverse_Primer | 264577 | 264553 |
| 475 | 240O17_region_G3_156785_13_Forward_Primer | 156713 | 156737 |
| 476 | 240O17_region_G3_156785_13_Reverse_Primer | 156868 | 156844 |
| 477 | 240O17_region_G3_187129_12_Forward_Primer | 187068 | 187092 |
| 478 | 240O17_region_G3_187129_12_Reverse_Primer | 187223 | 187199 |
| 479 | 240O17_region_G3_214106_13_Forward_Primer | 214042 | 214067 |
| 480 | 240O17_region_G3_214106_13_Reverse_Primer | 214197 | 214173 |
| 481 | 240O17_region_G3_149013_12_Forward_Primer | 148898 | 148922 |
| 482 | 240O17_region_G3_149013_12_Reverse_Primer | 149053 | 149027 |
| 483 | 240O17_region_G3_326352_16_Forward_Primer | 326311 | 326335 |
| 484 | 240O17_region_G3_326352_16_Reverse_Primer | 326467 | 326443 |
| 485 | 240O17_region_G3_278962_12_Forward_Primer | 278933 | 278957 |
| 486 | 240O17_region_G3_278962_12_Reverse_Primer | 279089 | 279065 |
| 487 | 240O17_region_G3_256930_13_Forward_Primer | 256850 | 256874 |
| 488 | 240O17_region_G3_256930_13_Reverse_Primer | 257006 | 256982 |
| 489 | 240O17_region_G3_29646_14_Forward_Primer | 29589 | 29613 |
| 490 | 240O17_region_G3_29646_14_Reverse_Primer | 29746 | 29721 |
| 491 | 240O17_region_G3_29618_13_Forward_Primer | 29589 | 29613 |
| 492 | 240O17_region_G3_29618_13_Reverse_Primer | 29746 | 29721 |
| 493 | 240O17_region_G3_108561_14_Forward_Primer | 108518 | 108542 |
| 494 | 240O17_region_G3_108561_14_Reverse_Primer | 108675 | 108651 |
| 495 | 240O17_region_G3_143975_14_Forward_Primer | 143939 | 143964 |
| 496 | 240O17_region_G3_143975_14_Reverse_Primer | 144096 | 144072 |
| 497 | 240O17_region_G3_108431_20_Forward_Primer | 108362 | 108386 |
| 498 | 240O17_region_G3_108431_20_Reverse_Primer | 108520 | 108497 |
| 499 | 240O17_region_G3_281764_11_Forward_Primer | 281645 | 281669 |
| 500 | 240O17_region_G3_281764_11_Reverse_Primer | 281803 | 281779 |
| 501 | 240O17_region_G3_130058_15_Forward_Primer | 129994 | 130018 |
| 502 | 240O17_region_G3_130058_15_Reverse_Primer | 130153 | 130129 |
| 503 | 240O17_region_G3_310590_52_Forward_Primer | 310533 | 310557 |
| 504 | 240O17_region_G3_310590_52_Reverse_Primer | 310692 | 310668 |
| 505 | 240O17_region_G3_313405_14_Forward_Primer | 313345 | 313369 |
| 506 | 240O17_region_G3_313405_14_Reverse_Primer | 313505 | 313481 |
| 507 | 240O17_region_G3_302190_13_Forward_Primer | 302093 | 302119 |
| 508 | 240O17_region_G3_302190_13_Reverse_Primer | 302253 | 302229 |
| 509 | 240O17_region_G3_225343_17_Forward_Primer | 225315 | 225338 |
| 510 | 240O17_region_G3_225343_17_Reverse_Primer | 225475 | 225451 |
| 511 | 240O17_region_G3_208823_14_Forward_Primer | 208760 | 208784 |
| 512 | 240O17_region_G3_208823_14_Reverse_Primer | 208921 | 208897 |
| 513 | 240O17_region_G3_74285_11_Forward_Primer | 74220 | 74244 |
| 514 | 240O17_region_G3_74285_11_Reverse_Primer | 74382 | 74358 |
| 515 | 240O17_region_G3_109052_16_Forward_Primer | 108999 | 109023 |
| 516 | 240O17_region_G3_109052_16_Reverse_Primer | 109161 | 109137 |
| 517 | 240O17_region_G3_6395_12_Forward_Primer | 6285 | 6309 |
| 518 | 240O17_region_G3_6395_12_Reverse_Primer | 6447 | 6423 |
| 519 | 240O17_region_G3_244905_16_Forward_Primer | 244865 | 244890 |
| 520 | 240O17_region_G3_244905_16_Reverse_Primer | 245028 | 245004 |
| 521 | 240O17_region_G3_244956_13_Forward_Primer | 244865 | 244890 |
| 522 | 240O17_region_G3_244956_13_Reverse_Primer | 245028 | 245004 |
| 523 | 240O17_region_G3_117220_13_Forward_Primer | 117175 | 117199 |
| 524 | 240O17_region_G3_117220_13_Reverse_Primer | 117339 | 117315 |
| 525 | 240O17_region_G3_134707_14_Forward_Primer | 134584 | 134608 |
| 526 | 240O17_region_G3_134707_14_Reverse_Primer | 134749 | 134725 |

TABLE 1-continued

| Seq Num | Seq ID | | |
|---|---|---|---|
| 527 | 240O17_region_G3_35078_13_Forward_Primer | 34990 | 35013 |
| 528 | 240O17_region_G3_35078_13_Reverse_Primer | 35157 | 35133 |
| 529 | 240O17_region_G3_210506_16_Forward_Primer | 210477 | 210501 |
| 530 | 240O17_region_G3_210506_16_Reverse_Primer | 210644 | 210620 |
| 531 | 240O17_region_G3_116961_26_Forward_Primer | 116885 | 116909 |
| 532 | 240O17_region_G3_116961_26_Reverse_Primer | 117053 | 117029 |
| 533 | 240O17_region_G3_51073_13_Forward_Primer | 50979 | 51003 |
| 534 | 240O17_region_G3_51073_13_Reverse_Primer | 51147 | 51123 |
| 535 | 240O17_region_G3_55291_15_Forward_Primer | 55164 | 55188 |
| 536 | 240O17_region_G3_55291_15_Reverse_Primer | 55333 | 55309 |
| 537 | 240O17_region_G3_229651_18_Forward_Primer | 229615 | 229639 |
| 538 | 240O17_region_G3_229651_18_Reverse_Primer | 229784 | 229760 |
| 539 | 240O17_region_G3_303308_19_Forward_Primer | 303284 | 303307 |
| 540 | 240O17_region_G3_303308_19_Reverse_Primer | 303454 | 303429 |
| 541 | 240O17_region_G3_168373_20_Forward_Primer | 168262 | 168286 |
| 542 | 240O17_region_G3_168373_20_Reverse_Primer | 168432 | 168408 |
| 543 | 240O17_region_G3_253333_17_Forward_Primer | 253257 | 253281 |
| 544 | 240O17_region_G3_253333_17_Reverse_Primer | 253428 | 253404 |
| 545 | 240O17_region_G3_5791_13_Forward_Primer | 5766 | 5790 |
| 546 | 240O17_region_G3_5791_13_Reverse_Primer | 5937 | 5912 |
| 547 | 240O17_region_G3_206841_19_Forward_Primer | 206821 | 206840 |
| 548 | 240O17_region_G3_206841_19_Reverse_Primer | 206993 | 206969 |
| 549 | 240O17_region_G3_202827_12_Forward_Primer | 202782 | 202806 |
| 550 | 240O17_region_G3_202827_12_Reverse_Primer | 202956 | 202932 |
| 551 | 240O17_region_G3_322656_13_Forward_Primer | 322572 | 322598 |
| 552 | 240O17_region_G3_322656_13_Reverse_Primer | 322748 | 322724 |
| 553 | 240O17_region_G3_111841_14_Forward_Primer | 111709 | 111733 |
| 554 | 240O17_region_G3_111841_14_Reverse_Primer | 111886 | 111861 |
| 555 | 240O17_region_G3_192719_13_Forward_Primer | 192589 | 192613 |
| 556 | 240O17_region_G3_192719_13_Reverse_Primer | 192767 | 192743 |
| 557 | 240O17_region_G3_195630_17_Forward_Primer | 195490 | 195514 |
| 558 | 240O17_region_G3_195630_17_Reverse_Primer | 195672 | 195648 |
| 559 | 240O17_region_G3_69999_13_Forward_Primer | 69858 | 69881 |
| 560 | 240O17_region_G3_69999_13_Reverse_Primer | 70040 | 70016 |
| 561 | 240O17_region_G3_11176_13_Forward_Primer | 11060 | 11084 |
| 562 | 240O17_region_G3_11176_13_Reverse_Primer | 11243 | 11219 |
| 563 | 240O17_region_G3_228643_13_Forward_Primer | 228529 | 228553 |
| 564 | 240O17_region_G3_228643_13_Reverse_Primer | 228713 | 228689 |
| 565 | 240O17_region_G3_88478_19_Forward_Primer | 88378 | 88402 |
| 566 | 240O17_region_G3_88478_19_Reverse_Primer | 88562 | 88538 |
| 567 | 240O17_region_G3_108950_13_Forward_Primer | 108838 | 108858 |
| 568 | 240O17_region_G3_108950_13_Reverse_Primer | 109023 | 108998 |
| 569 | 240O17_region_G3_121054_14_Forward_Primer | 120911 | 120935 |
| 570 | 240O17_region_G3_121054_14_Reverse_Primer | 121096 | 121072 |
| 571 | 240O17_region_G3_188337_14_Forward_Primer | 188204 | 188228 |
| 572 | 240O17_region_G3_188337_14_Reverse_Primer | 191544 | 191520 |
| 572 | 240O17_region_G3_188337_14_Reverse_Primer | 188391 | 188367 |
| 573 | 240O17_region_G3_255944_21_Forward_Primer | 255879 | 255903 |
| 574 | 240O17_region_G3_255944_21_Reverse_Primer | 256068 | 256044 |
| 575 | 240O17_region_G3_219518_14_Forward_Primer | 219420 | 219444 |
| 576 | 240O17_region_G3_219518_14_Reverse_Primer | 219609 | 219585 |
| 577 | 240O17_region_G3_235601_15_Forward_Primer | 235483 | 235507 |
| 578 | 240O17_region_G3_235601_15_Reverse_Primer | 235673 | 235649 |
| 579 | 240O17_region_G3_301529_13_Forward_Primer | 301498 | 301522 |
| 580 | 240O17_region_G3_301529_13_Reverse_Primer | 301689 | 301665 |
| 581 | 240O17_region_G3_94795_14_Forward_Primer | 94735 | 94756 |
| 582 | 240O17_region_G3_94795_14_Reverse_Primer | 94929 | 94905 |
| 583 | 240O17_region_G3_46703_23_Forward_Primer | 46676 | 46700 |
| 584 | 240O17_region_G3_46703_23_Reverse_Primer | 46870 | 46846 |
| 585 | 240O17_region_G3_59616_14_Forward_Primer | 59539 | 59563 |
| 586 | 240O17_region_G3_59616_14_Reverse_Primer | 59738 | 59714 |
| 587 | 240O17_region_G3_296933_15_Forward_Primer | 296908 | 296932 |
| 588 | 240O17_region_G3_296933_15_Reverse_Primer | 297113 | 297089 |
| 589 | 240O17_region_G3_192428_17_Forward_Primer | 192402 | 192426 |
| 590 | 240O17_region_G3_192428_17_Reverse_Primer | 192613 | 192589 |
| 591 | 240O17_region_G3_191490_14_Forward_Primer | 191332 | 191356 |
| 592 | 240O17_region_G3_191490_14_Reverse_Primer | 191544 | 191520 |
| 593 | 240O17_region_G3_201115_11_Forward_Primer | 200994 | 201018 |
| 594 | 240O17_region_G3_201115_11_Reverse_Primer | 201214 | 201189 |
| 595 | 240O17_region_G3_72882_15_Forward_Primer | 72848 | 72874 |
| 596 | 240O17_region_G3_72882_15_Reverse_Primer | 73068 | 73042 |
| 597 | 240O17_region_G3_69514_13_Forward_Primer | 69411 | 69437 |
| 598 | 240O17_region_G3_69514_13_Reverse_Primer | 69632 | 69608 |
| 599 | 240O17_region_G3_37699_47_Forward_Primer | 37601 | 37625 |
| 600 | 240O17_region_G3_37699_47_Reverse_Primer | 37827 | 37802 |
| 601 | 240O17_region_G3_11301_29_Forward_Primer | 11274 | 11300 |
| 602 | 240O17_region_G3_11301_29_Reverse_Primer | 11501 | 11477 |

TABLE 1-continued

| Seq Num | Seq ID | | |
|---|---|---|---|
| 603 | 240O17_region_G3_141875_12_Forward_Primer | 141729 | 141750 |
| 604 | 240O17_region_G3_141875_12_Reverse_Primer | 141964 | 141939 |
| 605 | 240O17_region_G3_98090_18_Forward_Primer | 98037 | 98062 |
| 606 | 240O17_region_G3_98090_18_Reverse_Primer | 98274 | 98250 |
| 607 | 240O17_region_G3_43298_35_Forward_Primer | 43144 | 43168 |
| 608 | 240O17_region_G3_43298_35_Reverse_Primer | 43387 | 43363 |
| 609 | 240O17_region_G3_262094_11_Forward_Primer | 261989 | 262014 |
| 610 | 240O17_region_G3_262094_11_Reverse_Primer | 262236 | 262211 |
| 611 | 240O17_region_G3_262079_15_Forward_Primer | 261989 | 262014 |
| 612 | 240O17_region_G3_262079_15_Reverse_Primer | 262236 | 262211 |
| 613 | 240O17_region_G3_59090_12_Forward_Primer | 58986 | 59012 |
| 614 | 240O17_region_G3_59090_12_Reverse_Primer | 59248 | 59224 |
| 615 | 240O17_region_G3_245723_13_Forward_Primer | 245502 | 245526 |
| 616 | 240O17_region_G3_245723_13_Reverse_Primer | 245766 | 245742 |
| 617 | 240O17_region_G3_194628_54_Forward_Primer | 194581 | 194607 |
| 618 | 240O17_region_G3_194628_54_Reverse_Primer | 194846 | 194822 |
| 619 | 240O17_region_G3_4566_16_Forward_Primer | 4455 | 4479 |
| 620 | 240O17_region_G3_4566_16_Reverse_Primer | 4722 | 4696 |
| 621 | 240O17_region_G3_96209_14_Forward_Primer | 96119 | 96143 |
| 622 | 240O17_region_G3_96209_14_Reverse_Primer | 96392 | 96368 |
| 623 | 240O17_region_G3_248715_17_Forward_Primer | 248633 | 248657 |
| 624 | 240O17_region_G3_248715_17_Reverse_Primer | 248906 | 248882 |
| 625 | 240O17_region_G3_71410_40_Forward_Primer | 71357 | 71379 |
| 626 | 240O17_region_G3_71410_40_Reverse_Primer | 71636 | 71611 |
| 627 | 240O17_region_G3_226519_13_Forward_Primer | 226315 | 226339 |
| 628 | 240O17_region_G3_226519_13_Reverse_Primer | 226598 | 226574 |
| 629 | 240O17_region_G3_11282_19_Forward_Primer | 11217 | 11242 |
| 630 | 240O17_region_G3_11282_19_Reverse_Primer | 11501 | 11477 |
| 631 | 240O17_region_G3_170504_12_Forward_Primer | 170409 | 170433 |
| 632 | 240O17_region_G3_170504_12_Reverse_Primer | 170694 | 170671 |
| 633 | 240O17_region_G3_40864_14_Forward_Primer | 40652 | 40678 |
| 634 | 240O17_region_G3_40864_14_Reverse_Primer | 40938 | 40912 |
| 635 | 240O17_region_G3_13529_14_Forward_Primer | 13332 | 13356 |
| 636 | 240O17_region_G3_13529_14_Reverse_Primer | 13622 | 13598 |
| 637 | 240O17_region_G3_22858_14_Forward_Primer | 22675 | 22699 |
| 638 | 240O17_region_G3_22858_14_Reverse_Primer | 22966 | 22942 |
| 639 | 240O17_region_G3_309211_13_Forward_Primer | 309092 | 309118 |
| 640 | 240O17_region_G3_309211_13_Reverse_Primer | 309383 | 309358 |
| 641 | 240O17_region_G3_55568_26_Forward_Primer | 55375 | 55399 |
| 642 | 240O17_region_G3_55568_26_Reverse_Primer | 55667 | 55642 |
| 643 | 240O17_region_G3_73238_16_Forward_Primer | 73043 | 73069 |
| 644 | 240O17_region_G3_73238_16_Reverse_Primer | 73342 | 73318 |
| 645 | 240O17_region_G3_52488_19_Forward_Primer | 52413 | 52437 |
| 646 | 240O17_region_G3_52488_19_Reverse_Primer | 52712 | 52688 |
| 647 | 318O13_region_A3_471518_14_Forward_Primer_Seq | 471464 | 471488 |
| 648 | 318O13_region_A3_471518_14_Reverse_Primer_Seq | 471567 | 471541 |
| 649 | 318O13_region_A3_231599_23_Forward_Primer_Seq | 231568 | 231592 |
| 650 | 318O13_region_A3_231599_23_Reverse_Primer_Seq | 231672 | 231651 |
| 651 | 318O13_region_A3_375912_13_Forward_Primer_Seq | 375845 | 375865 |
| 652 | 318O13_region_A3_375912_13_Reverse_Primer_Seq | 375954 | 375932 |
| 653 | 318O13_region_A3_180013_12_Forward_Primer_Seq | 179951 | 179974 |
| 654 | 318O13_region_A3_180013_12_Reverse_Primer_Seq | 180060 | 180038 |
| 655 | 318O13_region_A3_171606_14_Forward_Primer_Seq | 171545 | 171569 |
| 656 | 318O13_region_A3_171606_14_Reverse_Primer_Seq | 171657 | 171633 |
| 657 | 318O13_region_A3_416256_13_Forward_Primer_Seq | 416180 | 416203 |
| 658 | 318O13_region_A3_416256_13_Reverse_Primer_Seq | 416293 | 416269 |
| 659 | 318O13_region_A3_231395_15_Forward_Primer_Seq | 231339 | 231363 |
| 660 | 318O13_region_A3_231395_15_Reverse_Primer_Seq | 231461 | 231438 |
| 661 | 318O13_region_A3_5502_47Forward_Primer_Seq | 5461 | 5485 |
| 662 | 318O13_region_A3_5502_47_Reverse_Primer_Seq | 5585 | 5561 |
| 663 | 318O13_region_A3_93061_14_Forward_Primer_Seq | 92988 | 93012 |
| 664 | 318O13_region_A3_93061_14_Reverse_Primer_Seq | 93112 | 93090 |
| 665 | 318O13_region_A3_111684_19_Forward_Primer_Seq | 111646 | 111670 |
| 666 | 318O13_region_A3_111684_19_Reverse_Primer_Seq | 111772 | 111748 |
| 667 | 318O13_region_A3_69328_14_Forward_Primer_Seq | 69246 | 69269 |
| 668 | 318O13_region_A3_69328_14_Reverse_Primer_Seq | 69373 | 69349 |
| 669 | 318O13_region_A3_36529_17_Forward_Primer_Seq | 36488 | 36512 |
| 670 | 318O13_region_A3_36529_17_Reverse_Primer_Seq | 36617 | 36593 |
| 671 | 318O13_region_A3_139128_12_Forward_Primer_Seq | 139043 | 139067 |
| 672 | 318O13_region_A3_139128_12_Reverse_Primer_Seq | 139174 | 139150 |
| 673 | 318O13_region_A3_495674_13_Forward_Primer_Seq | 495592 | 495616 |
| 674 | 318O13_region_A3_495674_13_Reverse_Primer_Seq | 495723 | 495699 |
| 675 | 318O13_region_A3_187577_13_Forward_Primer_Seq | 187482 | 187506 |
| 676 | 318O13_region_A3_187577_13_Reverse_Primer_Seq | 187613 | 187590 |
| 677 | 318O13_region_A3_453036_14_Forward_Primer_Seq | 452999 | 453023 |
| 678 | 318O13_region_A3_453036_14_Reverse_Primer_Seq | 453132 | 453108 |
| 679 | 318O13_region_A3_374041_13_Forward_Primer_Seq | 373964 | 373988 |

TABLE 1-continued

| Seq Num | Seq ID | | |
|---|---|---|---|
| 680 | 318O13_region_A3_374041_13_Reverse_Primer_Seq | 374097 | 374073 |
| 681 | 318O13_region_A3_3412_11_Forward_Primer_Seq | 3319 | 3341 |
| 682 | 318O13_region_A3_3412_11_Reverse_Primer_Seq | 3454 | 3430 |
| 683 | 318O13_region_A3_276495_28_Forward_Primer_Seq | 276462 | 276485 |
| 684 | 318O13_region_A3_276495_28_Reverse_Primer_Seq | 276598 | 276574 |
| 685 | 318O13_region_A3_151839_17_Forward_Primer_Seq | 151744 | 151768 |
| 686 | 318O13_region_A3_151839_17_Reverse_Primer_Seq | 151882 | 151858 |
| 687 | 318O13_region_A3_292912_12_Forward_Primer_Seq | 292875 | 292899 |
| 688 | 318O13_region_A3_292912_12_Reverse_Primer_Seq | 293014 | 292990 |
| 689 | 318O13_region_A3_104560_12_Forward_Primer_Seq | 104464 | 104488 |
| 690 | 318O13_region_A3_104560_12_Reverse_Primer_Seq | 104604 | 104580 |
| 691 | 318O13_region_A3_65193_11_Forward_Primer_Seq | 65155 | 65179 |
| 692 | 318O13_region_A3_65193_11_Reverse_Primer_Seq | 65295 | 65271 |
| 693 | 318O13_region_A3_110573_70_Forward_Primer_Seq | 110533 | 110559 |
| 694 | 318O13_region_A3_110573_70_Reverse_Primer_Seq | 110674 | 110648 |
| 695 | 318O13_region_A3_65117_12_Forward_Primer_Seq | 65034 | 65058 |
| 696 | 318O13_region_A3_65117_12_Reverse_Primer_Seq | 65177 | 65153 |
| 697 | 318O13_region_A3_490837_16_Forward_Primer_Seq | 490762 | 490786 |
| 698 | 318O13_region_A3_490837_16_Reverse_Primer_Seq | 490905 | 490881 |
| 699 | 318O13_region_A3_107448_11_Forward_Primer_Seq | 107385 | 107411 |
| 700 | 318O13_region_A3_107448_11_Reverse_Primer_Seq | 107529 | 107505 |
| 701 | 318O13_region_A3_331_23_Forward_Primer_Seq | 276 | 301 |
| 702 | 318O13_region_A3_331_23_Reverse_Primer_Seq | 421 | 397 |
| 703 | 318O13_region_A3_193470_13_Forward_Primer_Seq | 193444 | 193468 |
| 704 | 318O13_region_A3_193470_13_Reverse_Primer_Seq | 193589 | 193565 |
| 705 | 318O13_region_A3_183305_14_Forward_Primer_Seq | 183239 | 183263 |
| 706 | 318O13_region_A3_183305_14_Reverse_Primer_Seq | 183384 | 183360 |
| 707 | 318O13_region_A3_55050_14_Forward_Primer_Seq | 54998 | 55022 |
| 708 | 318O13_region_A3_55050_14_Reverse_Primer_Seq | 55144 | 55120 |
| 709 | 318O13_region_A3_224693_21_Forward_Primer_Seq | 224656 | 224682 |
| 710 | 318O13_region_A3_224693_21_Reverse_Primer_Seq | 224803 | 224779 |
| 711 | 318O13_region_A3_207216_12_Forward_Primer_Seq | 207152 | 207176 |
| 712 | 318O13_region_A3_207216_12_Reverse_Primer_Seq | 207299 | 207276 |
| 713 | 318O13_region_A3_4654_22_Forward_Primer_Seq | 4612 | 4636 |
| 714 | 318O13_region_A3_4654_22_Reverse_Primer_Seq | 4760 | 4736 |
| 715 | 318O13_region_A3_408959_13_Forward_Primer_Seq | 408918 | 408942 |
| 716 | 318O13_region_A3_408959_13_Reverse_Primer_Seq | 409066 | 409042 |
| 717 | 318O13_region_A3_132288_22_Forward_Primer_Seq | 132192 | 132216 |
| 718 | 318O13_region_A3_132288_22_Reverse_Primer_Seq | 132340 | 132316 |
| 719 | 318O13_region_A3_292822_20_Forward_Primer_Seq | 292747 | 292771 |
| 720 | 318O13_region_A3_292822_20_Reverse_Primer_Seq | 292895 | 292871 |
| 721 | 318O13_region_A3_311076_12_Forward_Primer_Seq | 311027 | 311051 |
| 722 | 318O13_region_A3_311076_12_Reverse_Primer_Seq | 311175 | 311152 |
| 723 | 318O13_region_A3_509623_13_Forward_Primer_Seq | 509584 | 509608 |
| 724 | 318O13_region_A3_509623_13_Reverse_Primer_Seq | 509732 | 509708 |
| 725 | 318O13_region_A3_190404_14_Forward_Primer_Seq | 190358 | 190382 |
| 726 | 318O13_region_A3_190404_14_Reverse_Primer_Seq | 190506 | 190482 |
| 727 | 318O13_region_A3_164916_15_Forward_Primer_Seq | 164808 | 164832 |
| 728 | 318O13_region_A3_164916_15_Reverse_Primer_Seq | 164957 | 164933 |
| 729 | 318O13_region_A3_21028_13_Forward_Primer_Seq | 21001 | 21026 |
| 730 | 318O13_region_A3_21028_13_Reverse_Primer_Seq | 21150 | 21126 |
| 731 | 318O13_region_A3_208012_17_Forward_Primer_Seq | 207955 | 207979 |
| 732 | 318O13_region_A3_208012_17_Reverse_Primer_Seq | 208104 | 208085 |
| 733 | 318O13_region_A3_484089_14_Forward_Primer_Seq | 484036 | 484060 |
| 734 | 318O13_region_A3_484089_14_Reverse_Primer_Seq | 484185 | 484161 |
| 735 | 318O13_region_A3_332780_17_Forward_Primer_Seq | 332723 | 332747 |
| 736 | 318O13_region_A3_332780_17_Reverse_Primer_Seq | 332872 | 332853 |
| 737 | 318O13_region_A3_480137_37_Forward_Primer_Seq | 480059 | 480084 |
| 738 | 318O13_region_A3_480137_37_Reverse_Primer_Seq | 480208 | 480182 |
| 739 | 318O13_region_A3_441056_14_Forward_Primer_Seq | 441011 | 441035 |
| 740 | 318O13_region_A3_441056_14_Reverse_Primer_Seq | 441161 | 441138 |
| 741 | 318O13_region_A3_77486_11_Forward_Primer_Seq | 77447 | 77471 |
| 742 | 318O13_region_A3_77486_11_Reverse_Primer_Seq | 77597 | 77573 |
| 743 | 318O13_region_A3_272468_11_Forward_Primer_Seq | 272423 | 272447 |
| 744 | 318O13_region_A3_272468_11_Reverse_Primer_Seq | 272573 | 272549 |
| 745 | 318O13_region_A3_425319_17_Forward_Primer_Seq | 425233 | 425257 |
| 746 | 318O13_region_A3_425319_17_Reverse_Primer_Seq | 425383 | 425359 |
| 747 | 318O13_region_A3_413879_31_Forward_Primer_Seq | 413835 | 413859 |
| 748 | 318O13_region_A3_413879_31_Reverse_Primer_Seq | 413985 | 413961 |
| 749 | 318O13_region_A3_80477_64_Forward_Primer_Seq | 80440 | 80464 |
| 750 | 318O13_region_A3_80477_64_Reverse_Prime_Seq | 80591 | 80567 |
| 751 | 318O13_region_A3_277272_50_Forward_Primer_Seq | 277213 | 277237 |
| 752 | 318O13_region_A3_277272_50_Reverse_Primer_Seq | 277364 | 277340 |
| 753 | 318O13_region_A3_509642_13_Forward_Primer_Seq | 509604 | 509628 |
| 754 | 318O13_region_A3_509642_13_Reverse_Primer_Seq | 509755 | 509731 |
| 755 | 318O13_region_A3_321771_14_Forward_Primer_Seq | 321663 | 321687 |
| 756 | 318O13_region_A3_321771_14_Reverse_Primer_Seq | 321815 | 321791 |

TABLE 1-continued

| Seq Num | Seq ID | | |
|---|---|---|---|
| 757 | 318O13_region_A3_26788_12_Forward_Primer_Seq | 26734 | 26758 |
| 758 | 318O13_region_A3_26788_12_Reverse_Primer_Seq | 26886 | 26862 |
| 759 | 318O13_region_A3_262706_16_Forward_Primer_Seq | 262649 | 262673 |
| 760 | 318O13_region_A3_262706_16_Reverse_Primer_Seq | 262802 | 262778 |
| 761 | 318O13_region_A3_243928_16_Forward_Primer_Seq | 243891 | 243915 |
| 762 | 318O13_region_A3_243928_16_Reverse_Primer_Seq | 244044 | 244020 |
| 763 | 318O13_region_A3_23246_148_Forward_Primer_Seq | 23215 | 23239 |
| 764 | 318O13_region_A3_23246_148_Reverse_Primer_Seq | 23368 | 23344 |
| 765 | 318O13_region_A3_165406_12_Forward_Primer_Seq | 165367 | 165391 |
| 766 | 318O13_region_A3_165406_12_Reverse_Primer_Seq | 165521 | 165497 |
| 767 | 318O13_region_A3_486294_14_Forward_Primer_Seq | 486208 | 486232 |
| 768 | 318O13_region_A3_486294_14_Reverse_Primer_Seq | 486362 | 486338 |
| 769 | 318O13_region_A3_46754_12_Forward_Primer_Seq | 46661 | 46685 |
| 770 | 318O13_region_A3_46754_12_Reverse_Primer_Seq | 46816 | 46792 |
| 771 | 318O13_region_A3_381116_15_Forward_Primer_Seq | 381080 | 381104 |
| 772 | 318O13_region_A3_381116_15_Reverse_Primer_Seq | 381235 | 381211 |
| 773 | 318O13_region_A3_350369_11_Forward_Primer_Seq | 350295 | 350319 |
| 774 | 318O13_region_A3_350369_11_Reverse_Primer_Seq | 350450 | 350426 |
| 775 | 318O13_region_A3_138841_13_Forward_Primer_Seq | 138795 | 138819 |
| 776 | 318O13_region_A3_138841_13_Reverse_Primer_Seq | 138950 | 138926 |
| 777 | 318O13_region_A3_12158_142_Forward_Primer_Seq | 12117 | 12141 |
| 778 | 318O13_region_A3_12158_142_Reverse_Primer_Seq | 12272 | 12248 |
| 779 | 318O13_region_A3_315368_13_Forward_Primer_Seq | 315310 | 315334 |
| 780 | 318O13_region_A3_315368_13_Reverse_Primer_Seq | 315465 | 315441 |
| 781 | 318O13_region_A3_307549_13_Forward_Primer_Seq | 307464 | 307488 |
| 782 | 318O13_region_A3_307549_13_Reverse_Primer_Seq | 307619 | 307595 |
| 783 | 318O13_region_A3_159857_14_Forward_Primer_Seq | 159772 | 159796 |
| 784 | 318O13_region_A3_159857_14_Reverse_Primer_Seq | 159928 | 159904 |
| 785 | 318O13_region_A3_140551_15_Forward_Primer_Seq | 140454 | 140478 |
| 786 | 318O13_region_A3_140551_15_Reverse_Primer_Seq | 140610 | 140586 |
| 787 | 318O13_region_A3_279869_11_Forward_Primer_Seq | 279797 | 279821 |
| 788 | 318O13_region_A3_279869_11_Reverse_Primer_Seq | 279953 | 279929 |
| 789 | 318O13_region_A3_78292_35_Forward_Primer_Seq | 78265 | 78291 |
| 790 | 318O13_region_A3_78292_35_Reverse_Primer_Seq | 78422 | 78397 |
| 791 | 318O13_region_A3_185019_12_Forward_Primer_Seq | 184953 | 184977 |
| 792 | 318O13_region_A3_185019_12_Reverse_Primer_Seq | 185111 | 185087 |
| 793 | 318O13_region_A3_409164_13_Forward_Primer_Seq | 409082 | 409106 |
| 794 | 318O13_region_A3_409164_13_Reverse_Primer_Seq | 409240 | 409219 |
| 795 | 318O13_region_A3_75392_14_Forward_Primer_Seq | 75287 | 75311 |
| 796 | 318O13_region_A3_75392_14_Reverse_Primer_Seq | 75445 | 75421 |
| 797 | 318O13_region_A3_231320_12_Forward_Primer_Seq | 231269 | 231293 |
| 798 | 318O13_region_A3_231320_12_Reverse_Primer_Seq | 231429 | 231405 |
| 799 | 318O13_region_A3_381102_14_Forward_Primer_Seq | 381041 | 381064 |
| 800 | 318O13_region_A3_381102_14_Reverse_Primer_Seq | 381201 | 381176 |
| 801 | 318O13_region_A3_491826_15_Forward_Primer_Seq | 491753 | 491777 |
| 802 | 318O13_region_A3_491826_15_Reverse_Primer_Seq | 491914 | 491891 |
| 803 | 318O13_region_A3_56365_21_Forward_Primer_Seq | 56336 | 56360 |
| 804 | 318O13_region_A3_56365_21_Reverse_Primer_Seq | 56497 | 56473 |
| 805 | 318O13_region_A3_372628_15_Forward_Primer_Seq | 372554 | 372578 |
| 806 | 318O13_region_A3_372628_15_Reverse_Primer_Seq | 372715 | 372691 |
| 807 | 318O13_region_A3_217037_11_Forward_Primer_Seq | 216919 | 216943 |
| 808 | 318O13_region_A3_217037_11_Reverse_Primer_Seq | 217081 | 217057 |
| 809 | 318O13_region_A3_302609_11_Forward_Primer_Seq | 302575 | 302599 |
| 810 | 318O13_region_A3_302609_11_Reverse_Primer_Seq | 302737 | 302713 |
| 811 | 318O13_region_A3_341804_11_Forward_Primer_Seq | 341686 | 341710 |
| 812 | 318O13_region_A3_341804_11_Reverse_Primer_Seq | 341848 | 341824 |
| 807 | 318O13_region_A3_217037_11_Forward_Primer_Seq | 216919 | 216943 |
| 808 | 318O13_region_A3_217037_11_Reverse_Primer_Seq | 217081 | 217057 |
| 813 | 318O13_region_A3_264929_68_Forward_Primer_Seq | 264862 | 264886 |
| 814 | 318O13_region_A3_264929_68_Reverse_Primer_Seq | 265024 | 265000 |
| 815 | 318O13_region_A3_55499_12_Forward_Primer_Seq | 55400 | 55424 |
| 816 | 318O13_region_A3_55499_12_Reverse_Primer_Seq | 55563 | 55539 |
| 817 | 318O13_region_A3_295634_14_Forward_Primer_Seq | 295538 | 295562 |
| 818 | 318O13_region_A3_295634_14_Reverse_Primer_Seq | 295702 | 295677 |
| 819 | 318O13_region_A3_269358_15_Forward_Primer_Seq | 269242 | 269266 |
| 820 | 318O13_region_A3_269358_15_Reverse_Primer_Seq | 269406 | 269382 |
| 821 | 318O13_region_A3_457009_24_Forward_Primer_Seq | 456924 | 456948 |
| 822 | 318O13_region_A3_457009_24_Reverse_Primer_Seq | 457088 | 457064 |
| 823 | 318O13_region_A3_176598_14_Forward_Primer_Seq | 176554 | 176578 |
| 824 | 318O13_region_A3_176598_14_Reverse_Primer_Seq | 176718 | 176694 |
| 825 | 318O13_region_A3_278266_12_Forward_Primer_Seq | 278210 | 278234 |
| 826 | 318O13_region_A3_278266_12_Reverse_Primer_Seq | 278376 | 278350 |
| 827 | 318O13_region_A3_391810_12_Forward_Primer_Seq | 391683 | 391707 |
| 828 | 318O13_region_A3_391810_12_Reverse_Primer_Seq | 391851 | 391826 |
| 829 | 318O13_region_A3_269485_15_Forward_Primer_Seq | 269383 | 269407 |
| 830 | 318O13_region_A3_269485_15_Reverse_Primer_Seq | 269551 | 269527 |
| 831 | 318O13_region_A3_359247_17_Forward_Primer_Seq | 359218 | 359243 |

TABLE 1-continued

| Seq Num | Seq ID | | |
|---|---|---|---|
| 832 | 318O13_region_A3_359247_17_Reverse_Primer_Seq | 359386 | 359362 |
| 833 | 318O13_region_A3_315094_13_Forward_Primer_Seq | 314976 | 315002 |
| 834 | 318O13_region_A3_315094_13_Reverse_Primer_Seq | 315145 | 315120 |
| 835 | 318O13_region_A3_307823_13_Forward_Primer_Seq | 307784 | 307809 |
| 836 | 318O13_region_A3_307823_13_Reverse_Primer_Seq | 307953 | 307927 |
| 837 | 318O13_region_A3_248588_15_Forward_Primer_Seq | 248540 | 248564 |
| 838 | 318O13_region_A3_248588_15_Reverse_Primer_Seq | 248709 | 248684 |
| 839 | 318O13_region_A3_252426_85_Forward_Primer_Seq | 252398 | 252423 |
| 840 | 318O13_region_A3_252426_85_Reverse_Primer_Seq | 252568 | 252543 |
| 841 | 318O13_region_A3_513314_16_Forward_Primer_Seq | 513209 | 513233 |
| 842 | 318O13_region_A3_513314_16_Reverse_Primer_Seq | 513379 | 513355 |
| 843 | 318O13_region_A3_68183_14_Forward_Primer_Seq | 68108 | 68132 |
| 844 | 318O13_region_A3_68183_14_Reverse_Primer_Seq | 68279 | 68255 |
| 845 | 318O13_region_A3_471191_13_Forward_Primer_Seq | 471059 | 471083 |
| 846 | 318O13_region_A3_471191_13_Reverse_Primer_Seq | 471231 | 471206 |
| 847 | 318O13_region_A3_163547_18_Forward_Primer_Seq | 163459 | 163483 |
| 848 | 318O13_region_A3_163547_18_Reverse_Primer_Seq | 163632 | 163608 |
| 849 | 318O13_region_A3_417867_15_Forward_Primer_Seq | 417839 | 417863 |
| 850 | 318O13_region_A3_417867_15_Reverse_Primer_Seq | 418014 | 417990 |
| 851 | 318O13_region_A3_332465_14_Forward_Primer_Seq | 332346 | 332370 |
| 852 | 318O13_region_A3_332465_14_Reverse_Primer_Seq | 332523 | 332499 |
| 853 | 318O13_region_A3_207697_14_Forward_Primer_Seq | 207578 | 207602 |
| 854 | 318O13_region_A3_207697_14_Reverse_Primer_Seq | 207755 | 207731 |
| 855 | 318O13_region_A3_277229_43_Forward_Primer_Seq | 277186 | 277210 |
| 856 | 318O13_region_A3_277229_43_Reverse_Primer_Seq | 277364 | 277340 |
| 857 | 318O13_region_A3_36366_11_Forward_Primer_Seq | 36323 | 36345 |
| 858 | 318O13_region_A3_36366_11_Reverse_Primer_Seq | 36501 | 36477 |
| 859 | 318O13_region_A3_91970_12_Forward_Primer_Seq | 91938 | 91962 |
| 860 | 318O13_region_A3_91970_12_Reverse_Primer_Seq | 92116 | 92091 |
| 861 | 318O13_region_A3_211533_11_Forward_Primer_Seq | 211406 | 211430 |
| 862 | 318O13_region_A3_211533_11_Reverse_Primer_Seq | 211585 | 211561 |
| 863 | 318O13_region_A3_336301_11_Forward_Primer_Seq | 336174 | 336198 |
| 864 | 318O13_region_A3_336301_11_Reverse_Primer_Seq | 336353 | 336329 |
| 865 | 318O13_region_A3_441603_14_Forward_Primer_Seq | 441539 | 441563 |
| 866 | 318O13_region_A3_441603_14_Reverse_Primer_Seq | 441718 | 441694 |
| 867 | 318O13_region_A3_468354_15_Forward_Primer_Seq | 468263 | 468287 |
| 868 | 318O13_region_A3_468354_15_Reverse_Primer_Seq | 468442 | 468418 |
| 869 | 318O13_region_A3_188983_18_Forward_Primer_Seq | 188855 | 188879 |
| 870 | 318O13_region_A3_188983_18_Reverse_Primer_Seq | 189035 | 189009 |
| 871 | 318O13_region_A3_115502_17_Forward_Primer_Seq | 115469 | 115493 |
| 872 | 318O13_region_A3_115502_17_Reverse_Primer_Seq | 115649 | 115625 |
| 873 | 318O13_region_A3_163006_13_Forward_Primer_Seq | 162972 | 162996 |
| 874 | 318O13_region_A3_163006_13_Reverse_Primer_Seq | 163153 | 163129 |
| 875 | 318O13_region_A3_119283_14_Forward_Primer_Seq | 119199 | 119224 |
| 876 | 318O13_region_A3_119283_14_Reverse_Primer_Seq | 119381 | 119357 |
| 877 | 318O13_region_A3_491126_11_Forward_Primer_Seq | 491062 | 491086 |
| 878 | 318O13_region_A3_491126_11_Reverse_Primer_Seq | 491244 | 491220 |
| 879 | 318O13_region_A3_99512_21_Forward_Primer_Seq | 99398 | 99422 |
| 880 | 318O13_region_A3_99512_21_Reverse_Primer_Seq | 99581 | 99557 |
| 881 | 318O13_region_A3_280291_17_Forward_Primer_Seq | 280201 | 280226 |
| 882 | 318O13_region_A3_280291_17_Reverse_Primer_Seq | 280385 | 280361 |
| 883 | 318O13_region_A3_138443_19_Forward_Primer_Seq | 138304 | 138329 |
| 884 | 318O13_region_A3_138443_19_Reverse_Primer_Seq | 138488 | 138465 |
| 885 | 318O13_region_A3_115973_14_Forward_Primer_Seq | 115832 | 115856 |
| 886 | 318O13_region_A3_115973_14_Reverse_Primer_Seq | 116016 | 115992 |
| 887 | 318O13_region_A3_329977_14_Forward_Primer_Seq | 329864 | 329889 |
| 888 | 318O13_region_A3_329977_14_Reverse_Primer_Seq | 330050 | 330026 |
| 889 | 318O13_region_A3_205203_14_Forward_Primer_Seq | 205090 | 205115 |
| 890 | 318O13_region_A3_205203_14_Reverse_Primer_Seq | 205276 | 205252 |
| 891 | 318O13_region_A3_153114_12_Forward_Primer_Seq | 152969 | 152993 |
| 892 | 318O13_region_A3_153114_12_Reverse_Primer_Seq | 153156 | 153132 |
| 893 | 318O13_region_A3_34581_13_Forward_Primer_Seq | 34523 | 34547 |
| 894 | 318O13_region_A3_34581_13_Reverse_Primer_Seq | 34712 | 34688 |
| 895 | 318O13_region_A3_292577_19_Forward_Primer_Seq | 292549 | 292573 |
| 896 | 318O13_region_A3_292577_19_Reverse_Primer_Seq | 292739 | 292715 |
| 897 | 318O13_region_A3_445391_20_Forward_Primer_Seq | 445356 | 445382 |
| 898 | 318O13_region_A3_445391_20_Reverse_Primer_Seq | 445547 | 445523 |
| 899 | 318O13_region_A3_350540_17_Forward_Primer_Seq | 350421 | 350445 |
| 900 | 318O13_region_A3_350540_17_Reverse_Primer_Seq | 350612 | 350588 |
| 901 | 318O13_region_A3_453879_15_Forward_Primer_Seq | 453725 | 453750 |
| 902 | 318O13_region_A3_453879_15_Reverse_Primer_Seq | 453918 | 453894 |
| 903 | 318O13_region_A3_201246_13_Forward_Primer_Seq | 201128 | 201153 |
| 904 | 318O13_region_A3_201246_13_Reverse_Primer_Seq | 201321 | 201297 |
| 905 | 318O13_region_A3_326020_13_Forward_Primer_Seq | 325902 | 325927 |
| 906 | 318O13_region_A3_326020_13_Reverse_Primer_Seq | 326095 | 326071 |
| 907 | 318O13_region_A3_503801_14_Forward_Primer_Seq | 503656 | 503680 |
| 908 | 318O13_region_A3_503801_14_Reverse_Primer_Seq | 503849 | 503823 |

TABLE 1-continued

| Seq Num | Seq ID | | |
|---|---|---|---|
| 909 | 318O13_region_A3_302400_52_Forward_Primer_Seq | 302283 | 302307 |
| 910 | 318O13_region_A3_302400_52_Reverse_Primer_Seq | 302481 | 302456 |
| 911 | 318O13_region_A3_448857_15_Forward_Primer_Seq | 448748 | 448772 |
| 912 | 318O13_region_A3_448857_15_Reverse_Primer_Seq | 448947 | 448924 |
| 913 | 318O13_region_A3_48364_14_Forward_Primer_Seq | 48232 | 48256 |
| 914 | 318O13_region_A3_48364_14_Reverse_Primer_Seq | 48435 | 48412 |
| 915 | 318O13_region_A3_251804_48_Forward_Primer_Seq | 251738 | 251762 |
| 916 | 318O13_region_A3_251804_48_Reverse_Primer_Seq | 251942 | 251918 |
| 917 | 318O13_region_A3_382583_13_Forward_Primer_Seq | 382549 | 382574 |
| 918 | 318O13_region_A3_382583_13_Reverse_Primer_Seq | 382753 | 382728 |
| 919 | 318O13_region_A3_124737_14_Forward_Primer_Seq | 124641 | 124665 |
| 920 | 318O13_region_A3_124737_14_Reverse_Primer_Seq | 124846 | 124822 |
| 921 | 318O13_region_A3_124766_13_Forward_Primer_Seq | 124641 | 124665 |
| 922 | 318O13_region_A3_124766_13_Reverse_Primer_Seq | 124846 | 124822 |
| 923 | 318O13_region_A3_461351_16_Forward_Primer_Seq | 461218 | 461242 |
| 924 | 318O13_region_A3_461351_16_Reverse_Primer_Seq | 461426 | 461402 |
| 925 | 318O13_region_A3_64953_19_Forward_Primer_Seq | 64798 | 64823 |
| 926 | 318O13_region_A3_64953_19_Reverse_Primer_Seq | 65011 | 64987 |
| 927 | 318O13_region_A3_366586_13_Forward_Primer_Seq | 366508 | 366532 |
| 928 | 318O13_region_A3_366586_13_Reverse_Primer_Seq | 366722 | 366698 |
| 929 | 318O13_region_A3_46190_15_Forward_Primer_Seq | 46012 | 46037 |
| 930 | 318O13_region_A3_46190_15_Reverse_Primer_Seq | 46228 | 46205 |
| 931 | 318O13_region_A3_81016_11_Forward_Primer_Seq | 80927 | 80952 |
| 932 | 318O13_region_A3_81016_11_Reverse_Primer_Seq | 81146 | 81122 |
| 933 | 318O13_region_A3_134426_14_Forward_Primer_Seq | 134253 | 134277 |
| 934 | 318O13_region_A3_134426_14_Reverse_Primer_Seq | 134474 | 134449 |
| 935 | 318O13_region_A3_292724_14_Forward_Primer_Seq | 292549 | 292573 |
| 936 | 318O13_region_A3_292724_14_Reverse_Primer_Seq | 292771 | 292747 |
| 937 | 318O13_region_A3_187096_17_Forward_Primer_Seq | 187058 | 187082 |
| 938 | 318O13_region_A3_187096_17_Reverse_Primer_Seq | 187282 | 187257 |
| 939 | 318O13_region_A3_381693_13_Forward_Primer_Seq | 381658 | 381683 |
| 940 | 318O13_region_A3_381693_13_Reverse_Primer_Seq | 381885 | 381863 |
| 941 | 318O13_region_A3_361286_33_Forward_Primer_Seq | 361173 | 361197 |
| 942 | 318O13_region_A3_361286_33_Reverse_Primer_Seq | 361401 | 361376 |
| 943 | 318O13_region_A3_482668_14_Forward_Primer_Seq | 482592 | 482616 |
| 944 | 318O13_region_A3_482668_14_Reverse_Primer_Seq | 482821 | 482796 |
| 945 | 318O13_region_A3_128002_12_Forward_Primer_Seq | 127882 | 127906 |
| 946 | 318O13_region_A3_128002_12_Reverse_Primer_Seq | 128112 | 128087 |
| 947 | 318O13_region_A3_499270_14_Forward_Primer_Seq | 499184 | 499208 |
| 948 | 318O13_region_A3_499270_14_Reverse_Primer_Seq | 499422 | 499398 |
| 949 | 318O13_region_A3_231650_12_Forward_Primer_Seq | 231568 | 231592 |
| 950 | 318O13_region_A3_231650_12_Reverse_Primer_Seq | 231809 | 231788 |
| 951 | 318O13_region_A3_199851_13_Forward_Primer_Seq | 199762 | 199786 |
| 952 | 318O13_region_A3_199851_13_Reverse_Primer_Seq | 200012 | 199988 |
| 953 | 318O13_region_A3_324629_13_Forward_Primer_Seq | 324540 | 324564 |
| 954 | 318O13_region_A3_324629_13_Reverse_Primer_Seq | 324790 | 324766 |
| 955 | 318O13_region_A3_374190_19_Forward_Primer_Seq | 374129 | 374152 |
| 956 | 318O13_region_A3_374190_19_Reverse_Primer_Seq | 374394 | 374370 |
| 957 | 318O13_region_A3_460603_13_Forward_Primer_Seq | 460450 | 460474 |
| 958 | 318O13_region_A3_460603_13_Reverse_Primer_Seq | 460715 | 460691 |
| 959 | 318O13_region_A3_108681_14_Forward_Primer_Seq | 108524 | 108548 |
| 960 | 318O13_region_A3_108681_14_Reverse_Primer_Seq | 108791 | 108768 |
| 961 | 318O13_region_A3_459791_47_Forward_Primer_Seq | 459639 | 459663 |
| 962 | 318O13_region_A3_459791_47_Reverse_Primer_Seq | 459907 | 459883 |
| 963 | 318O13_region_A3_4257_20_Forward_Primer_Seq | 4172 | 4196 |
| 964 | 318O13_region_A3_4257_20_Reverse_Primer_Seq | 4450 | 4425 |
| 965 | 318O13_region_A3_238810_14_Forward_Primer_Seq | 238563 | 238589 |
| 966 | 318O13_region_A3_238810_14_Reverse_Primer_Seq | 238850 | 238826 |
| 967 | 318O13_region_A3_245817_14_Forward_Primer_Seq | 245713 | 245738 |
| 968 | 318O13_region_A3_245817_14_Reverse_Primer_Seq | 246001 | 245977 |
| 969 | 318O13_region_A3_245956_14_Forward_Primer_Seq | 245713 | 245738 |
| 970 | 318O13_region_A3_245956_14_Reverse_Primer_Seq | 246001 | 245977 |
| 971 | 318O13_region_A3_74148_14_Forward_Primer_Seq | 74050 | 74075 |
| 972 | 318O13_region_A3_74148_14_Reverse_Primer_Seq | 74338 | 74314 |
| 973 | 318O13_region_A3_74089_15_Forward_Primer_Seq | 74050 | 74075 |
| 974 | 318O13_region_A3_74089_15_Reverse_Primer_Seq | 74338 | 74314 |
| 975 | 318O13_region_A3_241686_12_Forward_Primer_Seq | 241470 | 241494 |
| 976 | 318O13_region_A3_241686_12_Reverse_Primer_Seq | 241765 | 241741 |
| 977 | 318O13_region_A3_47476_12_Forward_Primer_Seq | 47280 | 47304 |
| 978 | 318O13_region_A3_47476_127_Reverse_Primer_Seq | 47577 | 47554 |
| 979 | 318O13_region_A3_164550_12_Forward_Primer_Seq | 164323 | 164347 |
| 980 | 318O13_region_A3_164550_12_Reverse_Primer_Seq | 164621 | 164598 |
| 981 | 318O13_region_A3_101255_15_Forward_Primer_Seq | 101119 | 101144 |
| 982 | 318O13_region_A3_101255_15_Reverse_Primer_Seq | 101418 | 101392 |
| 983 | 515O02_region_G2_16189_11_Forward_Primer | 16144 | 16168 |
| 984 | 515O02_region_G2_16189_11_Reverse_Primer | 16244 | 16220 |
| 985 | 515O02_region_G2_71925_13_Forward_Primer | 71880 | 71905 |

TABLE 1-continued

| Seq Num | Seq ID | | |
|---|---|---|---|
| 986 | 515O02_region_G2_71925_13_Reverse_Primer | 71987 | 71963 |
| 987 | 515O02_region_G2_4707_12_Forward_Primer | 4660 | 4684 |
| 988 | 515O02_region_G2_4707_12Reverse_Primer | 4769 | 4743 |
| 989 | 515O02_region_G2_118904_18_Forward_Primer | 118847 | 118871 |
| 990 | 515O02_region_G2_118904_18_Reverse_Primer | 118957 | 118932 |
| 991 | 515O02_region_G2_13655_17_Forward_Primer | 13567 | 13592 |
| 992 | 515O02_region_G2_13655_17_Reverse_Primer | 13698 | 13673 |
| 993 | 515O02_region_G2_53900_13_Forward_Primer | 53843 | 53867 |
| 994 | 515O02_region_G2_53900_13_Reverse_Primer | 53985 | 53961 |
| 995 | 515O02_region_G2_8079_14_Forward_Primer | 8023 | 8047 |
| 996 | 515O02_region_G2_8079_14_Reverse_Primer | 8167 | 8143 |
| 997 | 515O02_region_G2_9969_28_Forward_Primer | 9917 | 9941 |
| 998 | 515O02_region_G2_9969_28_Reverse_Primer | 10062 | 10038 |
| 999 | 515O02_region_G2_72308_77_Forward_Primer | 72272 | 72298 |
| 1000 | 515O02_region_G2_72308_77_Reverse_Primer | 10062 | 10038 |
| 1001 | 515O02_region_G2_99475_19_Forward_Primer | 99408 | 99433 |
| 1002 | 515O02_region_G2_99475_19_Reverse_Primer | 99554 | 99530 |
| 1003 | 515O02_region_G2_118615_18_Forward_Primer | 118512 | 118535 |
| 1004 | 515O02_region_G2_118615_18_Reverse_Primer | 118658 | 118634 |
| 1005 | 515O02_region_G2_119001_46_Forward_Primer | 118931 | 118956 |
| 1006 | 515O02_region_G2_119001_46_Reverse_Primer | 119079 | 119055 |
| 1007 | 515O02_region_G2_118958_43_Forward_Primer | 118931 | 118956 |
| 1008 | 515O02_region_G2_118958_43_Reverse_Primer | 119079 | 119055 |
| 1009 | 515O02_region_G2_17197_13_Forward_Primer | 17128 | 17152 |
| 1010 | 515O02_region_G2_17197_13_Reverse_Primer | 17276 | 17252 |
| 1011 | 515O02_region_G2_105163_29_Forward_Primer | 105068 | 105092 |
| 1012 | 515O02_region_G2_105163_29_Reverse_Primer | 105217 | 105192 |
| 1013 | 515O02_region_G2_111335_13_Forward_Primer | 111308 | 111332 |
| 1014 | 515O02_region_G2_111335_13_Reverse_Primer | 111458 | 111434 |
| 1015 | 515O02_region_G2_106396_13_Forward_Primer | 106318 | 106342 |
| 1016 | 515O02_region_G2_106396_13_Reverse_Primer | 106469 | 106445 |
| 1017 | 515O02_region_G2_59229_17_Forward_Primer | 59203 | 59227 |
| 1018 | 515O02_region_G2_59229_17_Reverse_Primer | 59354 | 59330 |
| 1019 | 515O02_region_G2_73795_20_Forward_Primer | 73769 | 73793 |
| 1020 | 515O02_region_G2_73795_20_Reverse_Primer | 73921 | 73896 |
| 1021 | 515O02_region_G2_85664_20_Forward_Primer | 85586 | 85611 |
| 1022 | 515O02_region_G2_85664_20_Reverse_Primer | 85738 | 85714 |
| 1023 | 515O02_region_G2_36921_17_Forward_Primer | 36830 | 36854 |
| 1024 | 515O02_region_G2_36921_17_Reverse_Primer | 36983 | 36959 |
| 1025 | 515O02_region_G2_124150_19_Forward_Primer | 124073 | 124096 |
| 1026 | 515O02_region_G2_124150_19_Reverse_Primer | 124227 | 124203 |
| 1027 | 515O02_region_G2_5089_14_Forward_Primer | 4999 | 5024 |
| 1028 | 515O02_region_G2_5089_14_Reverse_Primer | 5156 | 5132 |
| 1029 | 515O02_region_G2_58221_15_Forward_Primer | 58197 | 58220 |
| 1030 | 515O02_region_G2_58221_15_Reverse_Primer | 58354 | 58330 |
| 1031 | 515O02_region_G2_96139_14_Forward_Primer | 96022 | 96046 |
| 1032 | 515O02_region_G2_96139_14_Reverse_Primer | 96182 | 96158 |
| 1033 | 515O02_region_G2_70595_13_Forward_Primer | 70472 | 70496 |
| 1034 | 515O02_region_G2_70595_13_Reverse_Primer | 70634 | 70608 |
| 1035 | 515O02_region_G2_4340_15_Forward_Primer | 4312 | 4337 |
| 1036 | 515O02_region_G2_4340_15_Reverse_Primer | 4477 | 4454 |
| 1037 | 515O02_region_G2_90417_11_Forward_Primer | 90335 | 90359 |
| 1038 | 515O02_region_G2_90417_11_Reverse_Primer | 90503 | 90479 |
| 1039 | 515O02_region_G2_49711_17_Forward_Primer | 49652 | 49676 |
| 1040 | 515O02_region_G2_49711_17_Reverse_Primer | 49820 | 49796 |
| 1041 | 515O02_region_G2_63053_13_Forward_Primer | 63005 | 63029 |
| 1042 | 515O02_region_G2_63053_13_Reverse_Primer | 63173 | 63148 |
| 1043 | 515O02_region_G2_63076_14_Forward_Primer | 63005 | 63029 |
| 1044 | 515O02_region_G2_63076_14_Reverse_Primer | 63173 | 63148 |
| 1045 | 515O02_region_G2_44442_12_Forward_Primer | 44335 | 44359 |
| 1046 | 515O02_region_G2_44442_12_Reverse_Primer | 44505 | 44481 |
| 1047 | 515O02_region_G2_44422_19_Forward_Primer | 44335 | 44359 |
| 1048 | 515O02_region_G2_44422_19_Reverse_Primer | 44505 | 44481 |
| 1049 | 515O02_region_G2_44158_19_Forward_Primer | 44075 | 44100 |
| 1050 | 515O02_region_G2_44158_19_Reverse_Primer | 44252 | 44227 |
| 1051 | 515O02_region_G2_44141_17_Forward_Primer | 44075 | 44100 |
| 1052 | 515O02_region_G2_44141_17_Reverse_Primer | 44252 | 44227 |
| 1053 | 515O02_region_G2_90762_17_Forward_Primer | 90637 | 90663 |
| 1054 | 515O02_region_G2_90762_17_Reverse_Primer | 90814 | 90790 |
| 1055 | 515O02_region_G2_106241_14_Forward_Primer | 106160 | 106184 |
| 1056 | 515O02_region_G2_106241_14_Reverse_Primer | 106341 | 106317 |
| 1057 | 515O02_region_G2_109676_12_Forward_Primer | 109609 | 109634 |
| 1058 | 515O02_region_G3_109676_12_Reverse_Primer | 109793 | 109768 |
| 1059 | 515O02_region_G2_86242_14_Forward_Primer | 86134 | 86158 |
| 1060 | 515O02_region_G2_86242_14_Reverse_Primer | 86318 | 86293 |
| 1061 | 515O02_region_G2_83109_12_Forward_Primer | 83017 | 83041 |
| 1062 | 515O02_region_G2_83109_12_Reverse_Primer | 83202 | 83178 |

TABLE 1-continued

| Seq Num | Seq ID | | |
|---|---|---|---|
| 1063 | 515O02_region_G2_10461_15_Forward_Primer | 10418 | 10442 |
| 1064 | 515O02_region_G2_10461_15_Reverse_Primer | 10609 | 10585 |
| 1065 | 515O02_region_G2_67608_15_Forward_Primer | 67552 | 67577 |
| 1066 | 515O02_region_G2_67608_15_Reverse_Primer | 67745 | 67721 |
| 1067 | 515O02_region_G2_63275_46_Forward_Primer | 63148 | 63173 |
| 1068 | 515O02_region_G2_63275_46_Reverse_Primer | 63347 | 63323 |
| 1069 | 515O02_region_G2_62405_14_Forward_Primer | 62374 | 62399 |
| 1070 | 515O02_region_G2_62405_14_Reverse_Primer | 62576 | 62552 |
| 1071 | 515O02_region_G2_33563_12_Forward_Primer | 33460 | 33484 |
| 1072 | 515O02_region_G2_33563_12_Reverse_Primer | 33670 | 33646 |
| 1073 | 515O02_region_G2_33146_14_Forward_Primer | 32949 | 32973 |
| 1074 | 515O02_region_G2_33146_14_Reverse_Primer | 33191 | 33167 |
| 1075 | 515O02_region_G2_102179_29_Forward_Primer | 102102 | 102126 |
| 1076 | 515O02_region_G2_102179_29_Reverse_Primer | 102352 | 102327 |
| 1077 | 515O02_region_G2_2646_15_Forward_Primer | 2553 | 2577 |
| 1078 | 515O02_region_G2_2646_15_Reverse_Primer | 2809 | 2784 |
| 1079 | 515O02_region_G2_76652_24_Forward_Primer | 76567 | 76591 |
| 1080 | 515O02_region_G2_76652_24_Reverse_Primer | 76835 | 76812 |
| 1081 | 515O02_region_G2_66280_14_Forward_Primer | 66052 | 66077 |
| 1082 | 515O02_region_G2_66280_14_Reverse_Primer | 66334 | 66309 |
| 1083 | 515O02_region_G2_54768_13_Forward_Primer | 54640 | 54666 |
| 1084 | 515O02_region_G2_54768_13_Reverse_Primer | 54923 | 54899 |
| 1085 | 515O02_region_G2_62580_14_Forward_Primer | 62552 | 62576 |
| 1086 | 515O02_region_G2_62580_14_Reverse_Primer | 62840 | 62816 |
| 1087 | 515O02_region_G2_34598_55_Forward_Primer | 34473 | 34497 |
| 1088 | 515O02_region_G2_34598_55_Reverse_Primer | 34765 | 34739 |
| 1089 | 515O02_region_G2_77680_13_Forward_Primer | 77444 | 77470 |
| 1090 | 515O02_region_G2_77680_13_Reverse_Primer | 77741 | 77716 |
| 1091 | 515O02_region_G2_77693_12_Forward_Primer | 77444 | 77470 |
| 1092 | 515O02_region_G2_77693_12_Reverse_Primer | 77741 | 77716 |
| 1093 | 515O02_region_G2_97392_14_Forward_Primer | 97255 | 97280 |
| 1094 | 515O02_region_G2_97392_14_Reverse_Primer | 97554 | 97530 |
| 1095 | 515O02_region_G2_97359_15_Forward_Primer | 97255 | 97280 |
| 1096 | 515O02_region_G2_97359_15_Reverse_Primer | 97554 | 97530 |
| 1120 | consensusLRR | | |
| 1121 | rhg1LRR | | |
| 1122 | Rhg4LRR | | |
| | Primer location on 240O17_region_G3 | | |
| 1123 | 240O17_region_G3_forward_1_b | 45046–45072 | |

DETAILED DESCRIPTION OF THE INVENTION

A) rhg1

The present invention provides a method for the production of a soybean plant having an rhg1 SCN resistant allele comprising: (A) crossing a first soybean plant having an rhg1 SCN rersistant allele with a second soybean plant having an rhg1 SCN sensitive allele to produce a segregating population; (B) screening the segregating population for a member having an rhg1 SCN resistant allele with a first nucleic acid molecule capable of specifically hybridizing to linkage group G, wherein the first nucleic acid molecule specifically hybridizes to a second nucleic acid molecule that is linked to the rhg1 SCN resistant allele; and, (C) selecting the member for further crossing and selection.

rhg1 is located on linkage group G (Concibido et al., *Crop Sci.* 36:1643–1650 (1996)). SCN resistant alleles of rhg1 provide partial resistance to SCN races 1, 2, 3, 5, 6, and 14 (Conciobido et al. (*Crop Sci.* 37:258–264 (1997)). Also, Webb (U.S. Pat. No. 5,491,081) reports that a QTL on linkage group G (rhg1) provides partial resistance to SCN races 1, 2, 3, 5, and 14. rhg1 and Rhg4 provide complete or nearly complete resistance to SCN race 3 (U.S. Pat. No. 5,491,081). While initially thought to be a recessive gene, rhg1 classification as a recessive gene has been questioned.

Using bioinformatic approaches, the rhg1 coding region is predicted to contain either four exons (rhg1, v.1)(coding coordinates 45163–45314, 45450–45509, 46941–48763, and 48975 49573 of SEQ ID NO: 2) or two exons (rhg1, v.2) (coding coordinates 46798–48763 and 48975 49573 of SEQ ID NO: 3). rhg1, v.1 encodes an 877 amino acid polypeptide. rhg1, v.2 encodes an 854 amino acid length polypeptide. rhg1 codes for a Xa21-like receptor kinase (SEQ ID NOs: 1097, 1098, and 1100–1115) (Song, et al., *Science* 270, 1804–1806 (1995)). rhg1 has an extracellular leucine rich repeat (LRR) domain (rhg1, v.1, SEQ ID NO: 1097, residues 164–457; rhg1, v.2, SEQ ID NO: 1098, residues 141–434), a transmembrane domain (rhg1, v.1, SEQ ID NO: 1097, residues 508–530; rhg1, v.2, SEQ ID NO: 1098, residues 33–51, and 485–507) and serine/threonine protein kinase (STK) domain (rhg1, v.1, SEQ ID NO: 1097, residues 578–869; rhg1, v.2, SEQ ID NO: 1098, residues 555–846). In a preferred embodiment, the LRR domain has multiple LRR repeats. In a more preferred embodiment, the LRR domain has 12 LRR repeats.

To identify proteins similar to the proteins encoded by rhg1 candidates, database searches are performed using the predicted peptide sequences. The rhg1 candidate shows similarity to CAA18124, which is the Arabidopsis putative receptor kinase (58.4% similarity and 35.8% identity, (CLUSTALW (default parameters), Thompson et al., *Nucleic Acids Res.* 22:4673–4680 (1994)), GCG package, Genetics Computer Group, Madison, Wis.), and the apple leucine-rich receptor-like protein kinase (g3641252) (53.2% similarity and 31.5% identity, (CLUSTALW (default parameters))), which has both LLR and STK domains, showing conservation in both the LLR and STK domains. The predicted LRR extracellular domain shows similarity to the tomato resistance genes Cf-2.1 (*Lycopersicon pimpinellifolium*) (66.9% similarity and 45.4% identity (CLUSTALW (default parameters))) and Cf-2.2 (*Lycopersicon pimpinellifolium*) (66.9% similarity and 45.4% identity (CLUSTALW (default parameters))).

FIG. 1 is an alignment of the LRR domain of the rhg1 gene. A consensus sequence for the LRR is shown as the top row of the alignment. Each row of amino acids represents an LRR domain. The boxed region indicates the putative β-turn/β-sheet structural motif postulated to be involved in ligand binding (Jones and Jones, *Adv. Bot. Res. Incorp. Adv. Plant Path.* 24;89–167 (1997)). The hydrophobic leucine residues are thought to project into the core of the protein while the flanking amino acids are thought to be solvent exposed where they may interact with the ligand (Kobe and Deisenhofer, *Nature* 374; 183–186 (1995)). Non-conservative changes in this region are thought to affect folding. An "x" represents an arbitrary amino acid while an "a" represents a hydrophobic residue (leucine, isoleucine, methionine, valine, or phenylalanine). Amino acid substitutions between resistant and sensitive phenotypes are bordered by a double line. The amino acid substitution within the 302–325 region is a histidine/asparagine substitution, and the amino acid substitution within the 422–445 region is a phenylalanine/serine substitution.

As used herein, a naturally occurring rhg1 allele is any allele that encodes for a protein having an extracellular LRR, a transmembrane domain, and STK domain where the naturally occurring allele is present on linkage group G and where certain rhg1 alleles, but not all rhg1 alleles, are capable of providing or contributing to resistance or partial resistance to a race of SCN. It is understood that such an allele can, using for example methods disclosed herein, be manipulated so that the nucleic acid molecule encoding the protein is no longer present on linkage group G. It is also understood that such an allele can, using for example methods disclosed herein, be manipulated so that the nucleic acid molecule sequence is altered.

As used herein, an rhg1 SCN resistant allele is any rhg1 allele where that allele alone or in combination with other SCN resistant alleles present in the plant, such as an Rhg4 SCN resistant allele, provides resistance to a race of SCN, and that resistance is due, at least in part, to the genetic contribution of the rhg1 allele.

SCN resistance or partial resistance is determined by a comparison of the plant in question with a known SCN sensitive host, Lee 74, according to the method set forth in Schmitt, *J. Nematol.* 20:392–395 (1988). As used herein, resistance to a particular race of SCN is defined as having less than 10% of cyst development relative to the SCN sensitive host Lee 74. Moreover, as used herein, partial resistance to a particular race of SCN is defined as having more than 10% but less than 75% of cyst development relative to the SCN sensitive host Lee 74.

Any soybean plant having an rhg1 SCN resistant allele can be used in conjunction with the present invention. Soybeans with known rhg1 SCN resistant alleles can be used. Such soybeans include but are not limited to PI548402 (Peking), PI200499, A2869, Jack, A2069, PI209332 (No:4), PI404166 (Krasnoaarmejkaja), PI404198 (Sun huan do), PI437654 (Er-hej-jan), PI438489 (Chiquita), PI507354 (Tokei 421), PI548655 (Forrest), PI548988 (Pickett), PI84751, PI437654, PI40792, Pyramid, Nathan, AG2201, A3469, AG3901, A3904, AG4301, AG4401, AG4501, AG4601, PION9492, PI88788, Dyer, Custer, Manokin, and Doles. In a preferred aspect, the soybean plant having an rhg1 SCN resistant allele is an rhg1 haplotype 2 allele. Examples of soybeans with an rhg1 haplotype 2 allele are PI548402 (Peking), PI404166 (Krasnoaarmejkaja), PI404198 (Sun huan do), PI437654 (Er-hej-jan), PI438489 (Chiquita), PI507354 (Tokei 421), PI548655 (Forrest), PI548988 (Pickett), PI84751, PI437654, and PI40792. In addition, using the methods or agents of the present invention, soybeans and wild relative of soybean such as *Glycine soja* can be screened for the presence of rhg1 SCN resistant alleles.

Any soybean plant having an rhg1 SCN sensitive allele can be used in conjunction with the present invention. Such soybeans include A3244, A2833, AG3001, Williams, Will, A2704, Noir, DK23-51, Lee 74, Essex, Minsoy, A1923, and Hutcheson. In a preferred aspect, the soybean plant having an rhg1 SCN sensitive allele is an rhg1 A3244 allele. In addition, using the methods or agents of the present invention, soybeans and wild relatives of soybean such as *Glycine soja* can be screened for the presence of rhg1 SCN sensitive alleles.

Table 2, below, is a table showing single nucleotide polymorphisms (SNPs) and insertions/deletions (INDEL) sites for eight haplotype sequences of rhg1.

TABLE 2

| Identification | | | | Base number of contig 240O17_region_G3 of reference line A3244 | | | | | | | | | |
|---|---|---|---|---|---|---|---|---|---|---|---|---|---|
| Hap | PI# | Line | Ph | 45173 | 45309 | 45400 | 45416 | 45439 | 45611 | 45916 | 45958 | 46049 | 46113 |
| 1 | — | A3244 | S | G | G | A | T | A | A | A | A | C | A |
| 2 | PI548402 | Peking | R | G | A | C | C | T | A | G | A | T | G |
| 3 | PI423871 | Toyosuzu | — | G | A | A | T | A | A | G | A | T | G |
| 4 | PI518672 | Will | S | G | G | A | T | A | A | A | A | C | A |
| 5 | — | A2704 | S | G | G | A | T | A | A | A | A | C | A |
| 6 | PI290136 | Noir | S | A | A | A | C | T | G | A | T | T | A |
| 7 | PI548658 | Lee 74 | S | A | A | A | C | T | G | A | T | T | A |
| 8 | PI200499 | — | R | G | A | A | C | A | A | A | A | T | A |
| N/A | PI548667 | Essex | S | A | A | A | C | T | G | A | T | T | A |
| N/A | PI548389 | Minsoy | S | G | G | A | T | A | A | A | A | C | A |
| N/A | PI360843 | Oshima | — | — | — | — | — | — | — | — | — | — | — |
| N/A | — | A2869 | R | — | — | — | — | — | — | — | — | — | — |
| N/A | PI540556 | Jack | R | — | — | — | — | — | — | — | — | — | — |
| N/A | — | A2069 | R | — | — | — | — | — | — | — | — | — | — |
| N/A | PI209332 | No.4 | R | — | — | — | — | — | — | — | — | — | — |

TABLE 2-continued

| Identification | | | | Base number of contig 240O17_region_G3 of reference line A3244 | | | | | | | | |
|---|---|---|---|---|---|---|---|---|---|---|---|---|
| Hap | PI# | Line | Ph | 46227 | 46703 | 47057 | 47140 | 47208 | 47571 | 47617 | 47796 | 47856 | 47937 |
| 1 | — | A3244 | S | d1 | 0 | T | C | C | G | C | A | T | T |
| 2 | PI548402 | Peking | R | 0 | d2 | C | C | C | G | C | C | C | C |
| 3 | PI423871 | Toyosuzu | — | 0 | 0 | T | C | C | G | C | C | C | C |
| 4 | PI518672 | Will | S | d1 | 0 | T | A | T | G | C | A | T | T |
| 5 | — | A2704 | S | d1 | 0 | T | A | T | G | C | A | T | T |
| 6 | PI290136 | Noir | S | 0 | d14 | T | C | C | A | A | C | C | C |
| 7 | PI548658 | Lee 74 | S | 0 | d14 | T | C | C | G | A | C | C | C |
| 8 | PI200499 | — | R | 0 | d14 | T | C | C | G | A | C | C | C |
| N/A | PI548667 | Essex | S | 0 | d14 | T | C | C | G | A | C | C | C |
| N/A | PI548389 | Minsoy | S | d1 | 0 | T | A | T | G | C | A | T | T |
| N/A | PI360843 | Oshima. | — | — | 0 | T | A | T | G | C | A | T/C | T/C |
| N/A | — | A2869 | R | 0 | d14 | T | C | C | G | A | C | C | C |
| N/A | PI540556 | Jack | R | — | — | — | — | — | — | — | C | C | C |
| N/A | — | A2069 | R | — | — | — | — | — | — | — | C | T/C | T/C |
| N/A | PI209332 | No.4 | R | — | — | — | — | — | — | — | C | C | C |

| Hap | PI# | Line | Ph | 48012 | 48060 | 48073 | 48135 | 48279 | 48413 | 48681 | 48881 | 49012 | 49316 |
|---|---|---|---|---|---|---|---|---|---|---|---|---|---|
| 1 | — | A3244 | S | T | C | C | A | C | G | A | 0 | A | T |
| 2 | PI548402 | Peking | R | T | C | C | G | C | G | G | d19 | G | T |
| 3 | PI423871 | Toyosuzu | — | T | C | C | G | C | G | A | 0 | A | T |
| 4 | PI518672 | Will | S | T | C | C | A | C | G | A | 0 | A | T |
| 5 | — | A2704 | S | C | T | T | G | T | C | — | 0 | G | C |
| 6 | PI290136 | Noir | S | C | T | T | G | T | C | G | 0 | G | C |
| 7 | PI548658 | Lee 74 | S | C | T | T | G | T | C | G | 0 | G | C |
| 8 | PI200499 | — | R | C | T | T | G | T | C | G | 0 | G | C |
| N/A | PI548667 | Essex | S | C | T | T | G | T | C | A/G | 0 | G | C |
| N/A | PI548389 | Minsoy | S | C/T | C/T | C/T | A | C | G | A | 0 | A | T |
| N/A | PI360843 | Oshimas. | — | T | C | C | A/G | C | G | A | 0 | A | T |
| N/A | — | A2869 | R | C | T | T | G | T | C | G | 0 | G | C |
| N/A | PI540556 | Jack | R | C | T | T | G | T | C | G | 0 | G | C |
| N/A | — | A2069 | R | C | T | T | A | T | C | G | 0 | G | C |
| N/A | PI209332 | No.4 | R | C | T | T | A/G | T | C | G | 0 | G | C |

In Table 2, discrete haplotypes are designated 1 through 8. N/A refers to a haplotype that is not characterized. The Plant Introduction classification number is indicated in the "PI#" column. A dash indicates that no PI number is known or assigned for the line under investigation. The line from which the sequences are derived is indicated in the "line" column, with a dash indicating an unknown or unnamed line. The "Ph." (phenotype) column of table 2 indicates whether a given line has been reported as resistant (R) to at least one race of SCN or sensitive (S).

The nucleotide bases located at each of 30 positions in each of the haplotype sequences is shown in the columns labeled "Base number of contig 240O17_region_G3 of reference line A3244." The base number at the top of each column corresponds to the base number in contig 240O17_region_G3 of reference line A3224 (SEQ ID NOs: 2 and 3). The letters G, A, C, and T correspond to the bases guanine, adenine, cytosine, and thymine. Two bases separated by a slash (A/G, C/T, or T/C) indicate uncertainty at the specified position of the haplotype sequence. A "d" followed by a number indicates a deletion of a the length specified. That is, d1 is a one base deletion, d2 is a two base deletion, d14 is a fourteen base deletion, and d19 is a nineteen base deletion. A zero (0) indicates no deletion. A dash indicates that the identity of the base is undetermined.

Examination of table 2 reveals that the amino acid substitutions in the rhg1 coding region are common to the resistant lines PI467312 (Cha-mo-shi-dou), PI88788 and the southern susceptible lines Essex, Hutcheson, Noir and A1923. As used herein, a "southern" cultivar is any cultivar from maturity groups VI, VII, VIII, IX, or X, and a "northern" cultivar is any cultivar from maturity groups 000, 00, 0, I, II, III, IV, or V. This data is consistent with the mapping experiments of Qui et al. (*Theor Appl Genet* 98:356–364 (1999)). Based on analysis of 200 $F_{2:3}$ families derived from a cross between Peking and Essex, the authors failed to detect any significant association with SCN resistance to races 1, 2, and 3, and the rhg1 locus on linkage group G. The authors point out that one of the markers, Bng122, which has been shown to have significant linkage to rhg1 (Concibido et al., *Crop Sci.* 36:1643–1650 (1996)), is not polymorphic in the population employed. It is also possible that the susceptible southern lines contain rhg1 and the susceptible phenotype reflects the polygenic nature of SCN resistance. In a study to uncover QTLs for sudden death syndrome (SDS) in soybean, two SCN resistant alleles originating from the susceptible parent Essex have been described (Hlnetkovsky et al., *Crop Sci.* 36:393–400).

Tables 3a, 3b, and 3c, below, show lines that share an rhg1 haplotype.

TABLE 3a

Haplotype 2 Lines

| PI# | Line | Ph. |
|---|---|---|
| PI548402 | Peking | R |
| PI404166 | Krasnoaarmejkaja | R |
| PI404198 | (Sun huan do) | R |
| PI437654 | Er-hej-jan | R |
| PI438489 | (Chiquita) | R |
| PI507354 | Tokei 421 | R |
| PI548655 | Forrest | R |
| PI548988 | Pickett | R |
| PI84751 | — | R |

TABLE 3a-continued

Haplotype 2 Lines

| PI# | Line | Ph. |
|---|---|---|
| PI437654 | — | R |
| PI40792 | — | — |

TABLE 3b

Haplotype 4 Lines

| PI# | Line | Ph. |
|---|---|---|
| — | Will | S |
| PI467312 | Cha-mo-shi-dou | R |
| PI88788 | — | R |

TABLE 3c

Haplotype 6 Lines

| PI# | Line | Ph. |
|---|---|---|
| — | Noir | S |
| — | A1923 | S |
| — | Hutcheson | S |

In Tables 3a, 3b, and 3c, Plant Introduction classification number is indicated in the "PI#" column. A dash indicates that no PI number is known or assigned for the line in question. The line from which the sequences are derived is indicated in the "line" column, with a dash indicating an unknown or unnamed line. The "Ph." column indicates whether a given line has been reported as resistant (R) to at least one race of SCN or sensitive (S), with a dash indicating that the phenotype is unknown.

In a preferred aspect, the source of either an rhg1 SCN sensitive allele or an rhg1 SCN resistant allele, or more preferably both, is an elite plant. An "elite line" is any line that has resulted from breeding and selection for superior agronomic performance. Examples of elite lines are lines that are commercially available to farmers or soybean breeders such as HARTZ™ variety H4994, HARTZ™ variety H5218, HARTZ™ variety H5350, HARTZ™ variety H5545, HARTZ™ variety H5050, HARTZ™ variety H5454, HARTZ™ variety H5233, HARTZ™ variety H5488, HARTZ™ variety HLA572, HARTZ™ variety H6200, HARTZ™ variety H6104, HARTZ™ variety H6255, HARTZ™ variety H6586, HARTZ™ variety H6191, HARTZ™ variety H7440, HARTZ™ variety H4452 Roundup Ready™, HARTZ™ variety H4994 Roundup Ready™, HARTZ™ variety H4988 Roundup Ready™, HARTZ™ variety H5000 Roundup Ready™, HARTZ™ variety H5147 Roundup Ready™, HARTZ™ variety H5247 Roundup Ready™, HARTZ™ variety H5350 Roundup Ready™, HARTZ™ variety H5545 Roundup Ready™, HARTZ™ variety H5855 Roundup Ready™, HARTZ™ variety H5088 Roundup Ready™, HARTZ™ variety H5164 Roundup Ready™, HARTZ™ variety H5361 Roundup Ready™, HARTZ™ variety H5566 Roundup Ready™, HARTZ™ variety H5181 Roundup Ready™, HARTZ™ variety H5889 Roundup Ready™, HARTZ™ variety H5999 Roundup Ready™, HARTZ™ variety H6013 Roundup Ready™, HARTZ™ variety H6255 Roundup Ready™, HARTZ™ variety H6454 Roundup Ready™, HARTZ™ variety H6686 Roundup Ready™, HARTZ™ variety H7152 Roundup Ready™, HARTZ™ variety H7550 Roundup Ready™, HARTZ™ variety H8001 Roundup Ready™ (HARTZ SEED, Stuttgart, Ark., U.S.A.); A0868, AG0901, A1553, A1900, AG1901, A1923, A2069, AG2101, AG2201, A2247, AG2301, A2304, A2396, AG2401, AG2501, A2506, A2553, AG2701, AG2702, A2704, A2833, A2869, AG2901, AG2902, AG3001, AG3002, A3204, A3237, A3244, AG3301, AG3302, A3404, A3469, AG3502, A3559, AG3601, AG3701, AG3704, AG3750, A3834, AG3901, A3904, A4045 AG4301, A4341, AG4401, AG4501, AG4601, AG4602, A4604, AG4702, AG4901, A4922, AG5401, A5547, AG5602, A5704, AG5801, AG5901, A5944, A5959, AG6101, QR4459 and QP4544 (Asgrow Seeds, Des Moines, Iowa, U.S.A.); DeKalb variety CX445 (DeKalb, Ill.). An elite plant is any plant from an elite line.

B) Rhg4

The present invention provides a method for the production of a soybean plant having an Rhg4 SCN resistant allele comprising: (A) crossing a first soybean plant having an Rhg4 SCN resistant allele with a second soybean plant having an Rhg4 SCN sensitive allele to produce a segregating population; (B) screening the segregating population for a member having an Rhg4 SCN resistant allele with a first nucleic acid molecule capable of specifically hybridizing to linkage group A2, wherein the first nucleic acid molecule specifically hybridizes to a second nucleic acid molecule linked to the Rhg4 SCN resistant allele; and, (C) selecting the member for further crossing and selection.

Rhg4 is located on linkage group A2 (Matson and Williams, *Crop Sci.* 5:447 (1965)). SCN resistant alleles of Rhg4 provide partial resistance to SCN races 1 and 3 (U.S. Pat. No. 5,491,081). Together, rhg1 and Rhg4 provide complete or nearly complete resistance to SCN race 3. The dominant gene, Rhg4, was found to be closely linked to the seed coat color locus (i) (Matson and Williams, *Crop Sci.* 5:447 (1965)). The i locus in Peking was also reported to be linked with a recessive gene for resistance to SCN (Sugiyama and Katsumi, *Jpn. J. Breed.* 16:83–86 (1966)). It is possible that Rhg4 and the recessive gene linked to the i locus are one and the same, which would call into question the classification of Rhg4 as a dominant gene.

Using bioinformatic approaches the Rhg4 coding region is predicted to contain 2 exons (coding coordinates 111805–113968 and 114684–115204 of SEQ ID NO: 4). Rhg4 encodes an 894 amino acid polypeptide. Rhg4 codes for a Xa21-like receptor kinase (SEQ ID NOs: 1099 and 1116–1119) (Song et al., *Science* 270, 1804–1806, (1995)). Rhg4 has an extracellular LRR domain (Rhg4, SEQ ID NO: 1099, residues 34–44), a transmembrane domain (Rhg4 SEQ ID NO: 1099, residues 449–471), and STK domain (Rhg4, SEQ ID NO: 1099, residues 531–830). In a preferred embodiment, the LRR domain has multiple LRR repeats. In a more preferred embodiment, the LRR domain has 12 LRR repeats.

To identify proteins similar to the Rhg4 candidate, database searches are performed using the predicted peptide sequences. The Rhg4 candidate shows similarity to TMK (Y07748)(73.0% similarity and 54.8% identity (CLUSTALW (default parameters))) and TMK1 PRECURSOR (70.6% similarity and 55.1% identity (CLUSTALW (default parameters))), which are rice and *Arabidopsis* receptor kinases, respectively. The predicted LRR extracellular domain reveals similarity to TMK (Y07748)(70.1% similarity and 46.6% identity (CLUSTALW (default parameters))), TMK1 PRECURSOR (g1707642) (65.8% similarity and 48.8% identity (CLUSTALW (default parameters))), and F21J9.1 (g2213607) (65.5% similarity and 45.6% identity (CLUSTALW (default parameters))).

FIG. 2 is an alignment of the LRR domain of the Rhg4 gene. A consensus sequence is shown as the top row. Each row of amino acids represents an LRR domain. The boxed region indicates the putative β-turn/β-sheet structural motif postulated to be involved in ligand binding (Jones and Jones, *Adv. Bot. Res. Incorp. Adv. Plant Path.* 24;89–167 (1997)). The hydrophobic leucine residues are thought to project into the core of the protein while the flanking amino acids are thought to be solvent exposed where they may interact with the ligand (Kobe and Deisenhofer, *Nature* 374; 183–186 (1995)). An "x" represents an arbitrary amino acid while an "a" represents a hydrophobic residue (leucine, isoleucine, methionine, valine, or phenylalanine).

Amino acid substitutions between resistant and sensitive phenotypes are bordered by a double line. The amino acid substitution within the 35–57 region is a histidine/glutamine substitution, and the amino acid substitution within the 81–104 region is a leucine/phenylalanine substitution.

As used herein, a naturally-occurring Rhg4 allele is any allele that encodes for a protein having an extracellular LRR domain, a transmembrane domain, and STK domain where the naturally occurring allele is present on linkage group A2 and where certain Rgh4 alleles, but not all Rgh4 alleles, are capable of providing or contributing to resistance or partial resistance to a race of SCN. It is understood that such an allele can, using, for example methods disclosed herein, be manipulated so that the nucleic acid molecule encoding the protein is no longer present on linkage group A2. It is also understood that such an allele can, using, for example methods disclosed herein, be manipulated so that the nucleic acid molecule sequence is altered.

As used herein, an Rhg4 SCN resistant allele is any Rhg4 allele where that allele alone or in combination with other SCN resistant alleles present in the plant, such as an rhg1 SCN resistant allele, provides resistance to a race of SCN, and that resistance is due, at least in part, to the genetic contribution of the Rhg4 allele.

Any soybean plant having an Rhg4 SCN resistant allele can be used in conjunction with the present invention. Soybeans with known Rhg4 SCN resistant alleles can be used. Such soybeans include, but are not limited to, PI548402 (Peking), PI437654 (Er-hej-jan), PI438489 (Chiquita), PI507354 (Tokei 421), PI548655 (Forrest), PI548988 (Pickett), PI88788, PI404198 (Sun Huan Do), PI404166 (Krasnoaarmejkaja), Hartwig, Manokin, Doles, Dyer, and Custer. In a preferred aspect, the soybean plant having an Rhg4 SCN resistant allele is an Rhg4 haplotype 3 allele in a plant having either an rhg1 haplotype 2 or rhg1 haplotype 4 allele. Examples of soybeans with an Rhg4 haplotype 3 allele are PI548402 (Peking), PI88788, PI404198 (Sun huan do), PI438489 (Chiquita), PI437654 (Er-hej-jan), PI404166 (Krasnoaarmejkaja), PI548655 (Forrest), PI548988 (Pickett), and PI507354 (Tokei 421). In addition, using the methods or agents of the present invention, soybeans and wild relatives of soybeans such as *Glycine soja* can be screened for the presence of Rhg4 SCN resistant alleles.

Table 4 below is a table showing single nucleotide polymorphisms (SNPs) for three haplolotype sequences of Rhg4.

TABLE 4

| Identification | | | | | Base number of contig 318O13_region_A3 | | | | | Markers | | |
|---|---|---|---|---|---|---|---|---|---|---|---|---|
| Hap | PI number | Line | Ph | Coat | 111933 | 112065 | 112101 | 112461 | 114066 | scn279 | scnb267 | scn273 |
| 1 | — | A2069 | R | yellow | T | A | T | A | T | 2 | 2 | 2 |
| 1 | — | A2869 | R | yellow | T | A | T | A | T | 2 | 2 | 2 |
| 1 | — | A3244 | S | yellow | T | A | T | A | T | 2 | 2 | 2 |
| 1 | PI87631 | Kindaizu | R | yellow | T | A | T | A | T | 2 | 2 | 2 |
| 1 | PI548389 | Minsoy | S | yellow | T | A | T | A | T | 2 | 2 | 2 |
| 1 | PI518664 | Hutcheson | S | yellow | T | A | T | A | T | 2 | 2 | 2 |
| 1 | PI548658 | Lee 74 | S | yellow | T | A | T | A | T | — | 2 | 2 |
| 2 | PI540556 | Jack | R | yellow | G | A | T | A | T | 2 | 2 | 1 |
| 2 | PI360843 | Oshimashirome | R | yellow | G | A | T | A | T | — | — | — |
| 2 | PI423871 | Toyosuzu | R | yellow | G | A | T | A | T | — | — | — |
| 3 | PI548402 | Peking | R | black | G | C | C | T | G | 1 | 1 | 1 |
| 3 | PI88788 | — | R | black | G | C | C | T | G | 1 | 1 | 1 |
| 3 | PI404198 B | (Sun huan do) | R | black | G | C | C | T | G | 1 | 1 | 1 |
| 3 | PI438489 B | (Chiquita) | R | black | G | C | C | T | G | 1 | 1 | 1 |
| 3 | PI437654 | Er-hej-jan | R | black | G | C | C | T | G | 2 | 1 | 1 |
| 3 | PI404166 | Krasnoaarmejkaja | R | black | G | C | C | T | G | 1 | 1 | — |
| 3 | PI290136 | Noir | S | black | G | C | C | T | G | 1 | 1 | 1 |
| 3 | PI548655 | Forrest | R | yellow | G | C | C | T | G | 1 | 1 | 1 |
| 3 | PI548988 | Pickett | R | yellow | G | C | C | T | G | 1 | 1 | 1 |
| 3 | PI507354 | Tokei 421 | R | yellow | G | C | C | T | G | 1 | 1 | 1 |
| N/A | PI467312 | Cha-mo-shi-dou | R | GnBr | G | C | C | T | — | 1 | 1 | 1 |
| N/A | PI209332 | No.4 | R | black | T | A | T | — | — | 2 | 2 | 2 |
| N/A | PI518672 | Will | S | yellow | T | A | T | — | T | 2 | 2 | 2 |
| N/A | PI548667 | Essex | S | yellow | T | A | T | — | T | 2 | 2 | 2 |

In Table 4, discrete haplotypes are designated 1 through 3. N/A refers to a haplotype that is not characterized. In Table 4, the Plant Introduction classification number is indicated in the "PI#" column. A dash indicates that no PI number is known or assigned for the line under investigation. The line from which the sequences are derived is indicated in the "line" column, with a dash indicating an unknown or unnamed line. The "Ph." column of Table 4 indicates whether a given line has been reported to be resistant (R) to at least one race of SCN, or sensitive (S). The "coat" column shows the phenotypic coat color of a seed as either yellow, black, green/brown (GnBr), or unknown/unassigned (dash). At the I locus, black seeded varieties harbor the i allele for black or imperfect black seed coat. In a preferred embodiment, the seed has a yellow coat.

The nucleotide base located at each of 5 positions in each of the haplotype sequences is shown in the columns labeled "Base number of contig 318013_region_A3." The base number at the top of each column correspond to the base number in the contig 318013_region_A3 of reference line A3244 (SEQ ID NO: 4). The letters G, A, C, and T correspond to the bases guanine, adenine, cytosine, and thymine. A dash indicates that the identity of the base is unknown.

Three different simple sequence repeat (SSR) or microsatellite markers that occur within the sequences, scn279 (SEQ ID NO: 292), scn267 (SEQ ID NO: 282), and scn273 (SEQ ID NO: 294), are listed under "markers." The allele of each marker occurring in a haplotype is indicated by a 1 or a 2, with a dash indicating that the information is not determined.

Any soybean plant having an Rhg4 SCN sensitive allele can be used in conjunction with the present invention. Such soybeans include A3244, Will, Noir, Lee 74, Essex, Minsoy, A2704, A2833, AG3001, Williams, DK23-51, and Hutcheson. In a preferred aspect, the soybean plant having an Rhg4 SCN sensitive allele is an Rhg4 A3244 allele. In addition, using the methods or agents of the present invention, soybeans and wild relative of soybean such as *Glycine soja* can be screened for the presence of Rhg4 SCN sensitive alleles.

In a preferred aspect, the source of either an Rhg4 SCN sensitive allele or an Rhg4 SCN resistant allele, or more preferably both, is an elite plant.

In table 5, below, rhg1 and Rhg4 haplotypes for various cultivars are compared.

TABLE 5

| | Identification | | | Haplotype | |
|---|---|---|---|---|---|
| PI# | Line | Coat | Ph. | rhg4 | rhg1 |
| — | A3244 | yellow | S | 1 | 1 |
| PI548402 | Peking | black | R | 3 | 2 |
| PI404198 B | (Sun huan do) | black | R | 3 | 2 |
| PI438489 B | (Chiquita) | black | R | 3 | 2 |
| PI437654 | Er-hej-jan | black | R | 3 | 2 |
| PI404166 | Krasnoaarmejkaja | black | R | 3 | 2 |
| PI548655 | Forrest | yellow | R | 3 | 2 |
| PI548988 | Pickett | yellow | R | 3 | 2 |
| PI507354 | Tokei 421 | yellow | R | 3 | 2 |
| PI88788 | — | black | R | 3 | 4 |
| PI467312 | Cha-mo-shi-dou | GnBr | R | N/A | 4 |
| — | Noir | black | S | 3 | 6 |
| — | Jack | yellow | R | 2 | N/A |
| PI360843 | Oshimashirome | yellow | R | 2 | N/A |
| PI423871 | Toyosuzu | yellow | R | 2 | 3 |
| PI209332 | No.4 | black | R | N/A | N/A |
| PI87631 | Kindaizu | yellow | R | 1 | — |
| — | Minsoy | yellow | S | 1 | N/A |
| — | Will | yellow | S | N/A | 4 |
| — | Hutcheson | yellow | S | 1 | 6 |
| — | Lee 74 | yellow | S | N/A | 7 |
| — | Essex | yellow | S | N/A | N/A |
| — | A2069 | yellow | R | 1 | N/A |
| — | A2869 | yellow | R | 1 | N/A |

In Table 5, haplotypes, as used in Tables 2 through 4, are listed for each line. N/A refers to a haplotype that is not characterized. The Plant Introduction classification number is indicated in the "PI#" column. A dash indicates that no PI number is known or assigned for the line under investigation. The line from which the sequences are derived is indicated in the "line" column, with a dash indicating an unknown or unnamed line. The "Ph." column of table 5 indicates whether a given line has been reported to be resistant (R) to at least one race of SCN, or sensitive (S). The "coat" column shows the phenotypic coat color of a seed as either yellow, black, green/brown (GnBr), or unknown/unassigned (dash). At the I locus, black seeded varieties harbor the i allele for black or imperfect black seed coat. In a preferred embodiment, the seed has a yellow coat.

Screening for rhg1 and Rhg4 Alleles

Any appropriate method can be used to screen for a plant having an rhg1 SCN resistant allele. Any appropriate method can be used to screen for a plant having an Rhg4 SCN resistant allele. In a preferred aspect of the present invention, a nucleic acid marker of the present invention can be used (see section entitled "Screening for rhg1 and Rhg4 alleles" and subsection (ii) of the section entitled "Agents").

Additional markers, such as SSRs, AFLP markers, RFLP markers, RAPD markers, phenotypic markers, SNPs, isozyme markers, microarray transcription profiles that are genetically linked to or correlated with alleles of a QTL of the present invention can be utilized (Walton, *Seed World* 22–29 (July, 1993); Burow and Blake, *Molecular Dissection of Complex Traits*, 13–29, Eds. Paterson, CRC Press, New York (1988)). Methods to isolate such markers are known in the art. For example, locus-specific SSRs can be obtained by screening a genomic library for SSRs, sequencing of "positive" clones, designing primers which flank the repeats, and amplifying genomic DNA with these primers. The size of the resulting amplification products can vary by integral numbers of the basic repeat unit. To detect a polymorphism, PCR products can be radiolabeled, separated on denaturing polyacrylamide gels, and detected by autoradiography. Fragments with size differences >4 bp can also be resolved on agarose gels, thus avoiding radioactivity.

Other SSR markers may be utilized. Amplification of simple tandem repeats, mainly of the $[CA]_n$ type were reported by Litt and Luty, *Amer. J. Human Genet.* 44:397–401 (1989); Smeets et al., *Human Genet.* 83:245–251 (1989); Tautz, *Nucleic Acids Res.* 17:6463–6472 (1989); Weber and May, *Am. J. Hum. Genet.* 44:388–396 (1989). Weber, *Genomics* 7:524–530 (1990), reported that the level of polymorphism detected by PCR-amplified $[CA]_n$ type SSRs depends on the number of the "perfect" (i.e., uninterrupted), tandemly repeated motifs. Below a certain threshold (i.e., 12 CA-repeats), the SSRs were reported to be primarily monomorphic. Above this threshold, however, the probability of polymorphism increases with SSR length. Consequently, long, perfect arrays of SSRs are preferred for the generation of markers, i.e., for the design and synthesis of flanking primers.

Suitable primers can be deduced from DNA databases (e.g., Akkaya et al., *Genetics*. 132:1131–1139 (1992)). Alternatively, size-selected genomic libraries (200 to 500 bp) can be constructed by, for example, using the following steps: (1) isolation of genomic DNA; (2) digestion with one or more 4 base-specific restriction enzymes; (3) size-selection of restriction fragments by agarose gel electrophoresis, excision and purification of the desire size fraction; (4) ligation of the DNA into a suitable vector and transformation into a suitable *E. coli* strain; (5) screening for the presence of SSRs by colony or plaque hybridization with a labeled probe; (6) isolation of positive clones and sequencing of the inserts; and (7) design of suitable primers flanking the SSR.

Establishing libraries with small, size-selected inserts can be advantageous for SSR isolation for two reasons: (1) long SSRs are often unstable in *E. coli*, and (2) positive clones can be sequenced without subcloning. A number of approaches have been reported for the enrichment of SSRs in genomic libraries. Such enrichment procedures are particularly useful if libraries are screened with comparatively rare tri- and tetranucleotide repeat motifs. One such approach has been described by Ostrander et al., *Proc. Natl. Acad. Sci.(U.S.A).* 89:3419–3423 (1992), who reported the generation of a small-insert phagemid library in an *E. coli* strain deficient in UTPase (d8t) and uracil-N-glycosylase (ung) genes. In the absence of UTPase and uracil-N-glycosylase, dUTP can compete with dTTP for the incorporation into DNA. Single-stranded phagemid DNA isolated from such a library can be primed with $[CA]_n$ and $[TG]_n$ primers for second strand synthesis, and the products used to transform a wild-type *E. coli* strain. Since under these conditions there will be selection against single-stranded, uracil-containing DNA molecules, the resulting library will consist of primer-extended, double-stranded products and an about 50-fold enrichment in CA-repeats.

Other reported enrichment strategies rely on hybridization selection of simple sequence repeats prior to cloning (Karagyozov et al., *Nucleic Acids Res.* 21:3911–3912 (1993); Armour et al., *Hum. Mol. Gen.* 3:599–605 (1994); Kijas et al., *Genome* 38:349–355 (1994); Kandpal et al., *Proc. Natl. Acad. Sci.(U.S.A.)* 91:88–92 (1994); Edwards et al., *Am. J. Hum. Genet.* 49:746–756 (1991)). Hybridization selection, can for example, involve the following steps: (1) genomic DNA is fragmented, either by sonication, or by digestion with a restriction enzyme; (2) genomic DNA fragments are ligated to adapters that allow a "whole genome PCR" at this or a later stage of the procedure; (3) genomic DNA fragments are amplified, denatured and hybridized with single-stranded SSR sequences bound to a nylon membrane; (4) after washing off unbound DNA, hybridizing fragments enriched for SSRs are eluted from the membrane by boiling or alkali treatment, reamplified using adapter-complementary primers, and digested with a restriction enzyme to remove the adapters; and (5) DNA fragments are ligated into a suitable vector and transformed into a suitable *E. coli* strain. SSRs can be found in up to 50–70% of the clones obtained from these procedures (Armour et al., *Hum. Mol. Gen.* 3:599–605 (1994); Edwards et al., *Am. J. Hum. Genet.* 49:746–756 (1991)).

An alternative hybridization selection strategy was reported by Kijas et al., *Genome* 38:599–605 (1994), which replaced the nylon membrane with biotinylated, SSR-complementary oligonucleotides attached to streptavidin-coated magnetic particles. SSR-containing DNA fragments are selectively bound to the magnetic beads, reamplified, restriction-digested and cloned.

It is further understood that other additional markers on linkage group G or A2 may be utilized (Morgante et al., Genome 37: 763–769 (1994)). As used herein, reference to the linkage group of G or A2 refers to the linkage group that corresponds to linkage groups U5 and U3, respectively from the genetic map of *Glycine max* (Mansur et al., Crop Sci. 36: 1327–1336 (1996), and linkage groups G and A2 respectively of *Glycine max x. Glycine sola* (Shoemaker et al., *Genetics* 144: 329–336 (1996)) that is present in *Glycine soja* (Soybase, an Agricultural Research Service, United States Department of Agriculture http-129.186.26.940/ and USDA —Agricultural Research Service: http-www.ars.usda.gov/)).

PCR-amplified SSRs can be used, because they are locus-specific, codominant, occur in large numbers and allow the unambiguous identification of alleles. Standard PCR-amplified SSR protocols use radioisotopes and denaturing polyacrylamide gels to detect amplified SSRs. In many situations, however, allele sizes are sufficiently different to be resolved on high percentage agarose gels in combination with ethidium bromide staining (Bell and Ecker, *Genomics* 19:137–144 (1994); Becker and Heun, *Genome* 38:991–998 (1995); Huttel, Ph.D. Thesis, University of Frankfurt, Germany (1996)). High resolution without applying radioactivity is also provided by nondenaturing polyacrylamide gels in combination with either ethidium bromide (Scrimshaw, *Biotechniques* 13:2189 (1992)) or silver straining (Klinkicht and Tautz, *Molecular Ecology* 1: 133–134 (1992); Neilan et al., *Biotechniques* 17:708–712 (1994)). An alternative of PCR-amplified SSRs typing involves the use of fluorescent primers in combination with a semi-automated DNA sequencer (Schwengel et al., *Genomics* 22:46–54 (1994)). Fluorescent PCR products can be detected by real-time laser scanning during gel electrophoresis. An advantage of this technology is that different amplification reactions as well as a size marker (each labeled with a different fluorophore) can be combined into one lane during electrophoresis. Multiplex analysis of up to 24 different SSR loci per lane has been reported (Schwengel et al., *Genomics* 22:46–54 (1994)).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

The most preferred method of achieving such amplification employs the polymerase chain reaction ("PCR") (Mullis et al., *Cold Spring Harbor Symp. Quant. Biol.* 51:263–273 (1986); Erlich et al., European Patent Appln. 50,424; European Patent Appln. 84,796, European Patent Application 258,017, European Patent Appln. 237,362; Mullis, European Patent Appln. 201,184; Mullis et al., U.S. Pat. No. 4,683,202; Erlich, U.S. Pat. No. 4,582,788; and Saiki et al., U.S. Pat. No. 4,683,194), using primer pairs that are capable of hybridizing to the proximal sequences that define a polymorphism in its double-stranded form.

In lieu of PCR, alternative methods, such as the "Ligase Chain Reaction" ("LCR") may be used (Barany, *Proc. Natl. Acad. Sci.(U.S.A.)* 88:189–193 (1991)). LCR uses two pairs of oligonucleotide probes to exponentially amplify a specific target. The sequences of each pair of oligonucleotides is selected to permit the pair to hybridize to abutting sequences of the same strand of the target. Such hybridization forms a substrate for a template-dependent ligase. As with PCR, the resulting products thus serve as a template in subsequent cycles and an exponential amplification of the desired sequence is obtained.

LCR can be performed with oligonucleotides having the proximal and distal sequences of the same strand of a polymorphic site. In one embodiment, either oligonucleotide will be designed to include the actual polymorphic site of the polymorphism. In such an embodiment, the reaction conditions are selected such that the oligonucleotides can be ligated together only if the target molecule either contains or lacks the specific nucleotide that is complementary to the polymorphic site present on the oligonucleotide. Alternatively, the oligonucleotides may be selected such that they do not include the polymorphic site (see, Segev, PCT Application WO 90/01069).

The "Oligonucleotide Ligation Assay" ("OLA") may alternatively be employed (Landegren et al., *Science* 241: 1077–1080 (1988)). The OLA protocol uses two oligonucleotides that are designed to be capable of hybridizing to abutting sequences of a single strand of a target. OLA, like LCR, is particularly suited for the detection of point mutations. Unlike LCR, however, OLA results in "linear" rather than exponential amplification of the target sequence.

Nickerson et al. have described a nucleic acid detection assay that combines attributes of PCR and OLA (Nickerson et al., *Proc. Natl. Acad. Sci.(U.S.A.)* 87:8923–8927 (1990)). In this method, PCR is used to achieve the exponential amplification of target DNA, which is then detected using OLA. In addition to requiring multiple, and separate, processing steps, one problem associated with such combinations is that they inherit all of the problems associated with PCR and OLA.

Schemes based on ligation of two (or more) oligonucleotides in the presence of a nucleic acid having the sequence of the resulting "di-oligonucleotide," thereby amplifying the di-oligonucleotide, are also known (Wu et al., *Genomics* 4:560–569 (1989)), and may be readily adapted to the purposes of the present invention.

Other known nucleic acid amplification procedures, such as allele-specific oligomers, branched DNA technology, transcription-based amplification systems, or isothermal amplification methods may also be used to amplify and analyze such polymorphisms (Malek et al., U.S. Pat. No. 5,130,238; Davey et al., European Patent Application 329,822; Schuster et al., U.S. Pat. No. 5,169,766; Miller et al., PCT Patent Application WO 89/06700; Kwoh, et al., *Proc. Natl. Acad. Sci.*(U.S.A.) 86:1173–1177 (1989); Gingeras et al., PCT Patent Application WO 88/10315; Walker et al., *Proc. Natl. Acad. Sci.(U.S.A.)* 89:392–396 (1992)).

Polymorphisms can also be identified by Single Strand Conformation Polymorphism (SSCP) analysis. SSCP is a method capable of identifying most sequence variations in a single strand of DNA, typically between 150 and 250 nucleotides in length (Elles, *Methods in Molecular Medicine: Molecular Diagnosis of Genetic Diseases*, Humana Press (1996); Orita et al., *Genomics* 5: 874–879 (1989)). Under denaturing conditions a single strand of DNA will adopt a conformation that is uniquely dependent on its sequence conformation. This conformation usually will be different, even if only a single base is changed. Most conformations have been reported to alter the physical configuration or size sufficiently to be detectable by electrophoresis. A number of protocols have been described for SSCP including, but not limited to, Lee et al., *Anal. Biochem.* 205: 289–293 (1992); Suzuki et al., *Anal. Biochem.* 192: 82–84 (1991); Lo et al., *Nucleic Acids Research* 20: 1005–1009 (1992); Sarkar et al., *Genomics* 13:441–443 (1992). It is understood that one or more of the nucleic acids of the present invention can be utilized as markers or probes to detect polymorphisms by SSCP analysis.

Polymorphisms may also be found using random amplified polymorphic DNA (RAPD) (Williams et al., *Nucl. Acids Res.* 18: 6531–6535 (1990)) and cleaveable amplified polymorphic sequences (CAPS) (Lyamichev et al., *Science* 260: 778–783 (1993)). It is understood that one or more of the nucleic acid molecules of the present invention can be utilized as markers or probes to detect polymorphisms by RAPD or CAPS analysis.

The identification of a polymorphism can be determined in a variety of ways. By correlating the presence or absence of it in a plant with the presence or absence of a phenotype, it is possible to predict the phenotype of that plant. If a polymorphism creates or destroys a restriction endonuclease cleavage site, or if it results in the loss or insertion of DNA (e.g., a variable nucleotide tandem repeat (VNTR) polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms" ("RFLPs"). RFLPs have been widely used in human and plant genetic analyses (Glassberg, UK Patent Application 2135774; Skolnick et al., *Cytogen. Cell Genet.* 32:58–67 (1982); Botstein et al., *Ann. J. Hum. Genet.* 32:314–331 (1980); Fischer et al. (PCT Application WO90/13668); Uhlen, PCT Application WO90/11369)).

A central attribute of "single nucleotide polymorphisms," or "SNPs" is that the site of the polymorphism is at a single nucleotide. SNPs have certain reported advantages over RFLPs and VNTRs. First, SNPs are more stable than other classes of polymorphisms. Their spontaneous mutation rate is approximately $10^{-9}$ (Komberg, DNA Replication, W.H. Freeman & Co., San Francisco, 1980), approximately 1,000 times less frequent than VNTRs (U.S. Pat. No. 5,679,524). Second, SNPs occur at greater frequency, and with greater uniformity than RFLPs and VNTRs. As SNPs result from sequence variation, new polymorphisms can be identified by sequencing random genomic or cDNA molecules. SNPs can also result from deletions, point mutations and insertions. Any single base alteration, whatever the cause, can be an SNP. The greater frequency of SNPs means that they can be more readily identified than the other classes of polymorphisms.

SNPs and insertion/deletions can be detected by methods, by any of a variety of methods including those disclosed in U.S. Pat. Nos. 5,210,015; 5,876,930 and 6,030,787 in which an oligonucleotide probe having reporter and quencher molecules is hybridized to a target polynucleotide. The probe is degraded by 5'→3' exonuclease activity of a nucleic acid polymerase. A useful assay is available from AB Biosystems (850 Lincoln Centre Drive, Foster City, Calif.) as the Taqman® assay.

Specific nucleotide variations such as SNPs and insertion/deletions can also be detected by labeled base extension methods as disclosed in U.S. Pat. Nos. 6,004,744; 6,013,431; 5,595,890; 5,762,876; and 5,945,283. These methods are based on primer extension and incorporation of detectable nucleoside triphosphates. The primer is designed to anneal to the sequence immediately adjacent to the variable nucleotide which can be can be detected after incorporation of as few as one labeled nucleoside triphosphate. U.S. Pat. No. 5,468,613 discloses allele specific oligonucleotide hybridizations where single or multiple nucleotide variations in nucleic acid sequence can be detected in nucleic acids by a process in which the sequence containing the nucleotide variation is amplified, spotted on a membrane and treated with a labeled sequence-specific oligonucleotide probe.

Such methods also include the direct or indirect sequencing of the site, the use of restriction enzymes where the respective alleles of the site create or destroy a restriction site, the use of allele-specific hybridization probes, the use of antibodies that are specific for the proteins encoded by the different alleles of the polymorphism or by other biochemical interpretation. SNPs can be sequenced by a number of methods. Two basic methods may be used for DNA sequencing, the chain termination method of Sanger et al., *Proc. Natl. Acad. Sci.(U.S.A.)* 74: 5463–5467 (1977), and the chemical degradation method of Maxam and Gilbert, *Proc. Nat. Acad. Sci.(U.S.A.)* 74: 560–564 (1977). Automation and advances in technology such as the replacement of radioisotopes with fluorescence-based sequencing have reduced the effort required to sequence DNA (Craxton, Methods, 2:

20–26 (1991); Ju et al., *Proc. Natl. Acad. Sci.* (*U.S.A.*) 92: 4347–4351 (1995); Tabor and Richardson, *Proc. Natl. Acad. Sci.*(*U.S.A.*) 92: 6339–6343 (1995)). Automated sequencers are available from, for example, Pharmacia Biotech, Inc., Piscataway, N.J. (Pharmacia ALF), LI-COR, Inc., Lincoln, Nebr. (LI-COR 4,000) and Millipore, Bedford, Mass. (Millipore BaseStation).

In addition, advances in capillary gel electrophoresis have also reduced the effort required to sequence DNA and such advances provide a rapid high resolution approach for sequencing DNA samples (Swerdlow and Gesteland, *Nucleic Acids Res.* 18:1415–1419 (1990); Smith, *Nature* 349:812–813 (1991); Luckey et al., *Methods Enzymol.* 218: 154–172 (1993); Lu et al., *J. Chromatog. A.* 680:497–501 (1994); Carson et al., *Anal. Chem.* 65:3219–3226 (1993); Huang et al., *Anal. Chem.* 64:2149–2154 (1992); Kheterpal et al., *Electrophoresis* 17:1852–1859 (1996); Quesada and Zhang, *Electrophoresis* 17:1841–1851 (1996); Baba, Yakugaku Zasshi 117:265–281 (1997), Marino, *Appl. Theor. Electrophor.* 5:1–5 (1995)).

The genetic linkage of marker molecules can be established by a gene mapping model such as, without limitation, the flanking marker model reported by Lander and Botstein, *Genetics,* 121:185–199 (1989), and the interval mapping, based on maximum likelihood methods described by Lander and Botstein, *Genetics,* 121:185–199 (1989), and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990). Additional software includes Qgene, Version 2.23 (1996), Department of Plant Breeding and Biometry, 266 Emerson Hall, Cornell University, Ithaca, N.Y.). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics,* 121:185–199 (1989), and further described by Arús and Moreno-González, *Plant Breeding*, Hayward, Bosemark, Romagosa (eds.) Chapman & Hall, London, pp. 314–331 (1993).

Additional models can be used. Many modifications and alternative approaches to interval mapping have been reported, including the use of non-parametric methods (Kruglyak and Lander, *Genetics,* 139:1421–1428 (1995)). Multiple regression methods or models can be also be used, in which the trait is regressed on a large number of markers (Jansen, *Biometrics in Plant Breed*, van Oijen, Jansen (eds.) Proceedings of the Ninth Meeting of the Eucarpia Section Biometrics in Plant Breeding, The Netherlands, pp. 116–124 (1994); Weber and Wricke, *Advances in Plant Breeding*, Blackwell, Berlin, 16 (1994)). Procedures combining interval mapping with regression analysis, whereby the phenotype is regressed onto a single putative QTL at a given marker interval, and at the same time onto a number of markers that serve as 'cofactors,' have been reported by Jansen and Stam, *Genetics,* 136:1447–1455 (1994) and Zeng, *Genetics,* 136:1457–1468 (1994). Generally, the use of cofactors reduces the bias and sampling error of the estimated QTL positions (Utz and Melchinger, *Biometrics in Plant Breeding*, van Oijen, Jansen (eds.) Proceedings of the Ninth Meeting of the Eucarpia Section Biometrics in Plant Breeding, The Netherlands, pp.195–204 (1994), thereby improving the precision and efficiency of QTL mapping (Zeng, *Genetics,* 136:1457–1468 (1994)). These models can be extended to multi-environment experiments to analyze genotype-environment interactions (Jansen et al., *Theo. Appl. Genet.* 91:33–37 (1995)).

Selection of an appropriate mapping or segregation populations is important to map construction. The choice of appropriate mapping population depends on the type of marker systems employed (Tanksley et al., *Molecular mapping plant chromosomes. Chromosome structure and function: Impact of new concepts* J. P. Gustafson and R. Appels (eds.), Plenum Press, New York, pp. 157–173 (1988)). Consideration must be given to the source of parents (adapted vs. exotic) used in the mapping population. Chromosome pairing and recombination rates can be severely disturbed (suppressed) in wide crosses (adapted x exotic) and generally yield greatly reduced linkage distances. Wide crosses will usually provide segregating populations with a relatively large array of polymorphisms when compared to progeny in a narrow cross (adapted x adapted).

As used herein, the progeny include not only, without limitation, the products of any cross (be it a backcross or otherwise) between two plants, but all progeny whose pedigree traces back to the original cross. Specifically, without limitation, such progeny include plants that have 12.5% or less genetic material derived from one of the two originally crossed plants. As used herein, a second plant is derived from a first plant if the second plant's pedigree includes the first plant.

An $F_2$ population is the first generation of selfing after the hybrid seed is produced. Usually a single $F_1$ plant is selfed to generate a population segregating for all the genes in Mendelian (1:2:1) fashion. Maximum genetic information is obtained from a completely classified $F_2$ population using a codorninant marker system (Mather, Measurement of Linkage in Heredity: Methuen and Co., (1938)). In the case of dominant markers, progeny tests (e.g., $F_3$, $BCF_2$) are required to identify the heterozygotes, thus making it equivalent to a completely classified $F_2$ population. However, this procedure is often prohibitive because of the cost and time involved in progeny testing. Progeny testing of $F_2$ individuals is often used in map construction where phenotypes do not consistently reflect genotype (e.g., disease resistance) or where trait expression is controlled by a QTL. Segregation data from progeny test populations (e.g., $F_3$ or $BCF_2$) can be used in map construction. Marker-assisted selection can then be applied to cross progeny based on marker-trait map associations ($F_2$, $F_3$), where linkage groups have not been completely disassociated by recombination events (i.e., maximum disequilibrium).

Recombinant inbred lines (RIL) (genetically related lines; usually >$F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter et al., *Proc. Natl. Acad. Sci.*(*U.S.A.*) 89:1477–1481 (1992)). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., *Proc. Natl. Acad. Sci.(U.S.A.)* 89:1477–1481 (1992)). Information obtained from backcross populations using either codominant or dominant markers is less than that obtained from $F_2$ populations because one, rather than two, recombinant gametes are sampled per plant. Backcross populations, however, are more informative (at low marker saturation) when compared to RELs as the distance between linked loci increases in RIL populations (i.e., about 0.15% recombination). Increased recombination can be beneficial for resolution of tight linkages, but may be undesirable in the construction of maps with low marker saturation.

Near-isogenic lines (NIL) created by many backcrosses to produce an array of individuals that are nearly identical in genetic composition except for the trait or genomic region under interrogation can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore, et al., *Proc. Natl. Acad. Sci.(U.S.A.)* 88:9828–9832 (1991)). In BSA, two bulked DNA samples are drawn from a segregating population originating from a single cross. These bulks contain individuals that are identical for a particular trait (resistant or sensitive to particular disease) or genomic region but arbitrary at unlinked regions (i.e., heterozygous). Regions unlinked to the target region will not differ between the bulked samples of many individuals in BSA.

Plants generated using a method of the present invention can be part of or generated from a breeding program. The choice of breeding method depends on the mode of plant reproduction, the heritability of the trait(s) being improved, and the type of cultivar used commercially (e.g., $F_1$ hybrid cultivar, pureline cultivar, etc). Selected, non-limiting approaches, for breeding the plants of the present invention are set forth below. A breeding program can be enhanced using marker assisted selection of the progeny of any cross. It is further understood that any commercial and non-commercial cultivars can be utilized in a breeding program. Factors such as, for example, emergence vigor, vegetative vigor, stress tolerance, disease resistance, branching, flowering, seed set, seed size, seed density, standability, and threshability etc. will generally dictate the choice.

For highly heritable traits, a choice of superior individual plants evaluated at a single location will be effective, whereas for traits with low heritability, selection should be based on mean values obtained from replicated evaluations of families of related plants. Popular selection methods commonly include pedigree selection, modified pedigree selection, mass selection, and recurrent selection. In a preferred embodiment a backcross or recurrent breeding program is undertaken.

The complexity of inheritance influences choice of the breeding method. Backcross breeding can be used to transfer one or a few favorable genes for a highly heritable trait into a desirable cultivar. This approach has been used extensively for breeding disease-resistant cultivars. Various recurrent selection techniques are used to improve quantitatively inherited traits controlled by numerous genes. The use of recurrent selection in self-pollinating crops depends on the ease of pollination, the frequency of successful hybrids from each pollination, and the number of hybrid offspring from each successful cross.

Breeding lines can be tested and compared to appropriate standards in environments representative of the commercial target area(s) for two or more generations. The best lines are candidates for new commercial cultivars; those still deficient in traits may be used as parents to produce new populations for further selection.

One method of identifying a superior plant is to observe its performance relative to other experimental plants and to a widely grown standard cultivar. If a single observation is inconclusive, replicated observations can provide a better estimate of its genetic worth. A breeder can select and cross two or more parental lines, followed by repeated selfing and selection, producing many new genetic combinations.

The development of new soybean cultivars requires the development and selection of soybean varieties, the crossing of these varieties and selection of superior hybrid crosses. The hybrid seed can be produced by manual crosses between selected male-fertile parents or by using male sterility systems. Hybrids are selected for certain single gene traits such as pod color, flower color, seed yield, pubescence color or herbicide resistance which indicate that the seed is truly a hybrid. Additional data on parental lines, as well as the phenotype of the hybrid, influence the breeder's decision whether to continue with the specific hybrid cross.

Pedigree breeding and recurrent selection breeding methods can be used to develop cultivars from breeding populations. Breeding programs combine desirable traits from two or more cultivars or various broad-based sources into breeding pools from which cultivars are developed by selfing and selection of desired phenotypes. New cultivars can be evaluated to determine which have commercial potential.

Pedigree breeding is used commonly for the improvement of self-pollinating crops. Two parents who possess favorable, complementary traits are crossed to produce an $F_1$. An $F_2$ population is produced by selfing one or several $F_1$'s. Selection of the best individuals in the best families is performed. Replicated testing of families can begin in the $F_4$ generation to improve the effectiveness of selection for traits with low heritability. At an advanced stage of inbreeding (i.e., $F_6$ and $F_7$), the best lines or mixtures of phenotypically similar lines are tested for potential release as new cultivars.

Backcross breeding has been used to transfer genes for a simply inherited, highly heritable trait into a desirable homozygous cultivar or inbred line, which is the recurrent parent. The source of the trait to be transferred is called the donor parent. The resulting plant is expected to have the attributes of the recurrent parent (e.g., cultivar) and the desirable trait transferred from the donor parent. After the initial cross, individuals possessing the phenotype of the donor parent are selected and repeatedly crossed (backcrossed) to the recurrent parent. The resulting parent is expected to have the attributes of the recurrent parent (e.g., cultivar) and the desirable trait transferred from the donor parent.

The single-seed descent procedure in the strict sense refers to planting a segregating population, harvesting a sample of one seed per plant, and using the one-seed sample to plant the next generation. When the population has been advanced from the $F_2$ to the desired level of inbreeding, the plants from which lines are derived will each trace to different $F_2$ individuals. The number of plants in a population declines each generation due to failure of some seeds to germinate or some plants to produce at least one seed. As a result, not all of the $F_2$ plants originally sampled in the population will be represented by a progeny when generation advance is completed.

In a multiple-seed procedure, soybean breeders commonly harvest one or more pods from each plant in a population and thresh them together to form a bulk. Part of the bulk is used to plant the next generation and part is put in reserve. The procedure has been referred to as modified single-seed descent or the pod-bulk technique.

The multiple-seed procedure has been used to save labor at harvest. It is considerably faster to thresh pods with a machine than to remove one seed from each by hand for the single-seed procedure. The multiple-seed procedure also makes it possible to plant the same number of seeds of a population each generation of inbreeding.

Descriptions of other breeding methods that are commonly used for different traits and crops can be found in one of several reference books (e.g., Fehr, *Principles of Cultivar Development Vol.* 1, pp. 2–3 (1987)).

In a preferred aspect of the present invention the source of the rhg1 SCN resistant allele for use in a breeding program is derived from a plant selected from the group consisting of PI548402 (Peking), PI200499, A2869, Jack, A2069, PI209332 (No:4), PI404166 (Krasnoaarmejkaja), PI404198 (Sun huan do), PI437654 (Er-hej-jan), PI438489 (Chiquita), PI507354 (Tokei 421), PI548655 (Forrest), PI548988 (Pickett), PI84751, PI437654, PI40792, Pyramid, Nathan, AG2201, A3469, AG3901, A3904, AG4301, AG4401, AG4501, AG4601, PION9492, PI88788, Dyer, Custer, Manokin, Doles, and SCN resistant progeny thereof (USDA, Soybean Germplasm Collection, University of Illinois, Illinois). In a more preferred aspect, the source of the rhg1 SCN resistant allele for use in a breeding program is derived from a plant selected from the group consisting of PI548402 (Peking), PI404166 (Krasnoaarmejkaja), PI404198 (Sun huan do), PI437654 (Er-hej-jan), PI438489 (Chiquita), PI507354 (Tokei 421), PI548655 (Forrest), PI548988 (Pickett), PI84751, PI437654, PI40792, and SCN resistant progeny thereof.

In a preferred aspect of the present invention the source of the rhg1 SCN sensitive allele for use in a breeding program is derived from a plant selected from the group consisting of A3244, A2833, AG3001, Williams, Will, A2704, Noir, DK23-5 1, Lee 74, Essex, Minsoy, A1923, Hutcheson, and SCN sensitive progeny thereof. In a more preferred aspect, the source of the rhg1 SCN sensitive allele for use in a breeding program is derived from an A3244 plant, and SCN sensitive progeny thereof.

In a preferred aspect of the present invention the source of the Rhg4 SCN resistant allele for use in a breeding program is derived from a plant selected from the group consisting of PI548402 (Peking), PI437654 (Er-hej-jan), PI438489 (Chiquita), PI507354 (Tokei 421), PI548655 (Forrest), PI548988 (Pickett), PI88788, PI404198 (Sun Huan Do), PI404166 (Krasnoaarmejkaja), Hartwig, Manokin, Doles, Dyer, Custer, and SCN resistant progeny thereof. In a more preferred aspect, the source of the Rhg4 SCN resistant allele for use in a breeding program is derived from a plant selected from the group consisting of PI548402 (Peking), PI88788, PI404198 (Sun huan do), PI438489 (Chiquita), PI437654 (Er-hej-jan), PI404166 (Krasnoaarmejkaja), PI548655 (Forrest), PI548988 (Pickett), PI507354 (Tokei 421), and SCN resistant progeny thereof.

In a preferred aspect of the present invention the source of the Rhg4 SCN sensitive allele for use in a breeding program is derived from a plant selected from the group consisting of A3244, Will, Noir, Lee 74, Essex, Minsoy, A2704, A2833, AG3001, Williams, DK23-51, and Hutcheson, and SCN sensitive progeny thereof. In a more preferred aspect, the source of the Rhg4 SCN sensitive allele for use in a breeding program is derived from an A3244 plant, and SCN sensitive progeny thereof.

As used herein linkage of a nucleic acid sequence with another nucleic acid sequence may be genetic or physical. In a preferred embodiment, a nucleic acid marker is genetically linked to either rhg1 or Rhg4, where the marker nucleic acid molecule exhibits a LOD score of greater than 2.0, as judged by interval mapping, for SCN resistance or partial resistance, preferably where the marker nucleic acid molecule exhibits a LOD score of greater than 3.0, as judged by interval mapping, for SCN resistance or partial resistance, more preferably where the marker nucleic acid molecule exhibits a LOD score of greater than 3.5, as judged by interval mapping, for SCN resistance or partial resistance and even more preferably where the marker nucleic acid molecule exhibits a LOD score of about 4.0, as judged by interval mapping, for SCN resistance or partial resistance based on maximum likelihood methods described by Lander and Botstein, *Genetics,* 121:185–199 (1989), and implemented in the software package MAPMAKER/QTL (default parameters)(Lincoln and Lander, *Mapping Genes Controlling Quantitative Traits Using MAPMAKER/QTL*, Whitehead Institute for Biomedical Research, Massachusetts, (1990)).

In another embodiment the nucleic acid molecule may be physically linked to either rhg1 or Rhg4. In a preferred embodiment, the nucleic acid marker specifically hybridizes to a nucleic acid molecule having a sequence that is present on linkage group G within 500 kb or 100 kb, more preferably within 50 kb, even more preferably within 25 kb of an rhg1 allele, where the rgh1 allele is preferably a sensitive allele, and more preferably a sensitive allele from A3244. In a preferred embodiment the nucleic acid marker is capable of specifically hybridizing to a nucleic acid molecule having a sequence that is present on linkage group A2 within 500 kb or 100 kb, more preferably within 50 kb, even more preferably within 25 kb of an Rhg4 allele, where the Rgh4 allele is preferably a sensitive allele, and more preferably a sensitive allele from A3244.

The present invention provides a method of investigating an rhg1 haplotype of a soybean plant comprising: (A) isolating nucleic acid molecules from the soybean plant; (B) determining the nucleic acid sequence of an rhg1 allele or part thereof; and, (C) comparing the nucleic acid sequence of the rhg1 allele or part thereof to a reference nucleic acid sequence.

As used herein, the term "investigating" refers to any method capable of detecting a feature, such as a polymorphism or haplotype. Nucleic acid molecules only need to be isolated from a soybean plant to the degree of purity necessary for the task required or to a greater purity if desired. A person of ordinary skill in the art has available techniques to isolate nucleic acid molecules from plants to a sufficient purity, for example without limitation, to sequence the desired region of the nucleic acid molecule or to carry out a marker assay.

The determination of an rhg1 or Rhg4 allele or part thereof may be carried out using any technique. Illustration of such techniques include techniques that provide the nucleic acid sequence for an rhg1 or rhg4 allele or part thereof include amplification of a desired allele or part thereof (see, for example, the Examples and SEQ ID NOs: 8–53). In a preferred embodiment, the nucleic acid sequence determined is that of an exon of an rhg1 allele, more preferably exon 1 or exon 3 of an rhg1 allele, or of an LRR domain. In another preferred embodiment, a single nucleotide is determined. In another preferred embodiment, the nucleic acid sequence determined is that of an LRR domain.

A comparison of a sequence with a reference sequence can be carried out with any appropriate sequence comparison method.

As used herein, a reference sequence is any rhg1 allele sequence or consensus sequence. A reference sequence may be a nucleic acid sequence or an amino acid sequence. In a preferred embodiment, the reference sequence is any SCN resistant rhg1 allele sequence. In a further preferred embodiment, the rhg1 reference sequence is selected from the group consisting of SEQ ID NOs: 2, 3, 5, 6, 8–23, 28–43, 1097, 1098, and 1100–1115.

The present invention provides a method of investigating an Rhg4 haplotype of a soybean plant comprising: (A) isolating nucleic acid molecules from the soybean plant; (B) determining the nucleic acid sequence of an Rhg4 allele or part thereof; and (C) comparing the nucleic acid sequence of the Rhg4 allele or part thereof to a reference nucleic acid sequence.

As used herein, a reference sequence is any Rhg4 allele sequence or consensus sequence. A reference sequence ma be a nucleic acid sequence or an amino acid sequence. In a preferred embodiment, the reference sequence is any SCN resistant Rhg4 allele sequence. In a further preferred embodiment, the Rhg4 reference sequence is selected from the group consisting of SEQ ID NOs: 4, 7, 44–47, 50–53, 1099, and 1116–1119.

The present invention provides a method of introgressing SCN resistance or partial SCN resistance into a soybean plant comprising: performing marker assisted selection of the soybean plant with a nucleic acid marker, wherein the nucleic acid marker specifically hybridizes with a nucleic acid molecule having a first nucleic acid sequence that is physically linked to a second nucleic acid sequence that is located on linkage group G of soybean A3244, wherein the second nucleic acid sequence is within 500 kb of a third nucleic acid sequence which is capable of specifically hybridizing with the nucleic acid sequence of SEQ ID NO: 5, 6, complements thereof, or fragments thereof; and, selecting the soybean plant based on the marker assisted selection.

The present invention provides a method of introgressing SCN resistance or partial SCN resistance into a soybean plant comprising: performing marker assisted selection of the soybean plant with a nucleic acid marker, wherein the nucleic acid marker specifically hybridizes with a nucleic acid molecule having a first nucleic acid sequence that is physically linked to a second nucleic acid sequence that is located on linkage group A2 of soybean A3244, wherein the second nucleic acid sequence is within 500 kb of a third nucleic acid sequence which is capable of specifically hybridizing with the nucleic acid sequence of SEQ ID NO: 7, complements thereor, or fragments thereof; and, selecting the soybean plant based on the marker assisted selection. Marker assisted introgression of traits into plants has been reported. Marker assisted introgression involves the transfer of a chromosome region defined by one or more markers from one germplasm to a second germplasm. In a preferred embodiment the introgression is carried out by backcrossing with an rhg1 or Rhg4 SCN resistant soybean recurrent parent.

In light of the current disclosure, plant introductions and germplasm can be screened with a marker nucleic acid molecule of the present invention to screen for alleles of rhg1 or Rhg4 using one or more of techniques disclosed herein or known in the art.

The present invention also provides for parts of the plants produced by a method of the present invention. Plant parts, without limitation, include seed, endosperm, ovule and pollen. In a particularly preferred embodiment of the present invention, the plant part is a seed.

Plants or parts thereof produced by a method of the present invention may be grown in culture and regenerated. Methods for the regeneration of soybean plants from various tissue types and methods for the tissue culture of soybean are known in the art (See, for example, Widholm et al., *In Vitro Selection and Culture-induced Variation in Soybean*, In Soybean: Genetics, Molecular Biology and Biotechnology, Eds. Verma and Shoemaker, CAB International, Wallingford, Oxon, England (1996)). Regeneration techniques for plants such as soybean can use as the starting material a variety of tissue or cell types. With soybean in particular, regeneration processes have been developed that begin with certain differentiated tissue types such as meristems, Cartha et al., *Can. J. Bot.* 59:1671–1679 (1981), hypocotyl sections, Cameya et al., *Plant Science Letters* 21: 289–294 (1981), and stem node segments, Saka et al., *Plant Science Letters,* 19: 193–201 (1980); Cheng et al., *Plant Science Letters,* 19: 91–99 (1980). Regeneration of whole sexually mature soybean plants from somatic embryos generated from explants of immature soybean embryos has been reported (Ranch et al, In Vitro *Cellular & Developmental Biology* 21: 653–658 (1985). Regeneration of mature soybean plants from tissue culture by organogenesis and embryogenesis has also been reported (Barwale et al., *Planta* 167: 473–481 (1986); Wright et al., Plant Cell Reports 5: 150–154 (1986)).

Agents

One skilled in the art can refer to general reference texts for detailed descriptions of known techniques discussed herein or equivalent techniques. These texts include *Current Protocols in Molecular Biology Ausubel*, et al., eds., John Wiley & Sons, N.Y. (1989), and supplements through September (1998), *Molecular Cloning, A Laboratory Manual*, Sambrook et al, 2$^{nd}$ Ed., Cold Spring Harbor Press, Cold Spring Harbor, N.Y. (1989), *Genome Analysis: A Laboratory Manual 1: Analyzing DNA*, Birren et al., Cold Spring Harbor Press, Cold Spring Harbor, N.Y. (1997); *Genome Analysis: A Laboratory Manual 2: Detecting Genes*, Birren et al., Cold Spring Harbor Press, Cold Spring Harbor, N.Y. (1998); *Genome Analysis: A Laboratory Manual* 3: *Cloning Systems*, Birren et al., Cold Spring Harbor Press, Cold Spring Harbor, N.Y. (1999); *Genome Analysis: A Laboratory Manual* 4: *Mapping Genomes,* Birren et al., Cold Spring Harbor Press, Cold Spring Harbor, N.Y. (1999); Plant Molecular Biology: A Laboratory Manual, Clark, Springer-Verlag, Berlin, (1997), *Methods in Plant Molecular Biology*, Maliga et al., Cold Spring Harbor Press, Cold Spring Harbor, N.Y. (1995). These texts can, of course, also be referred to in making or using an aspect of the invention. It is understood that any of the agents of the invention can be substantially purified and/or be biologically active and/or recombinant.

(a) Nucleic Acid Molecules

Nucleic acid molecules of the present invention include, without limitation, nucleic acid molecules having a nucleic acid sequence selected from the group consisting of SEQ ID NOs: 1 1096 and complements thereof. A subset of the nucleic acid molecules of the present invention includes nucleic acid molecules that encode a protein or fragment thereof. Another subset of the nucleic acid molecules of the present invention are cDNA molecules. Another subset of the nucleic acid molecules of the present invention includes nucleic acid molecules that are marker molecules. A further subset of the nucleic acid molecules of the present invention are those nucleic acid molecules having promoter sequences.

Fragment nucleic acid molecules may comprise significant portion(s) of, or indeed most of, these nucleic acid molecules. In preferred embodiments, the fragments may comprise smaller polynucleotides, e.g., oligonucleotides having from about 20 to about 250 nucleotide residues and more preferably, about 20 to about 100 nucleotide residues, or about 40 to about 60 nucleotide residues. In another preferred embodiment, fragment molecules may be at least 15 nucleotides, at least 30 nucleotides, at least 50 nucleotides, or at least 100 nucleotides.

The term "substantially purified," as used herein, refers to a molecule separated from substantially all other molecules normally associated with it in its native state. More preferably a substantially purified molecule is the predominant species present in a preparation. A substantially purified molecule may be greater than 60% free, preferably 75% free, more preferably 90% free, and most preferably 95% free from the other molecules (exclusive of solvent) present in the natural mixture. The term "substantially purified" is not intended to encompass molecules present in their native state.

The agents of the present invention will preferably be "biologically active" with respect to either a structural attribute, such as the capacity of a nucleic acid to hybridize to another nucleic acid molecule, or the ability of a protein to be bound by an antibody (or to compete with another molecule for such binding). Alternatively, such an attribute may be catalytic and thus involve the capacity of the agent to mediate a chemical reaction or response.

The agents of the present invention may also be recombinant. As used herein, the term recombinant describes (a) nucleic acid molecules that are constructed or modified outside of cells and that can replicate or function in a living cell, (b) molecules that result from the transcription, replication or translation of recombinant nucleic acid molecules, or (c) organisms that contain recombinant nucleic acid molecules or are modified using recombinant nucleic acid molecules.

It is understood that the agents of the present invention may be labeled with reagents that facilitate detection of the agent, e.g., fluorescent labels, (Prober et al., *Science* 238: 336–340 (1987); Albarella et al., EP 144914), chemical labels, (Sheldon et al., U.S. Pat. No. 4,582,789; Albarella et al., U.S. Pat. No. 4,563,417), and modified bases, (Miyoshi et al., EP 119448) including nucleotides with radioactive elements, e.g., $^{32}$P, $^{33}$P, $^{35}$S or $^{125}$I, such as $^{32}$P dCTP.

It is further understood, that the present invention provides recombinant bacterial, animal, fungal and plant cells and viral constructs comprising the agents of the present invention.

Nucleic acid molecules or fragments thereof of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit "complete complementarity," i.e., each nucleotide in one sequence is complementary to its base pairing partner nucleotide in another sequence. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Nucleic acid molecules which hybridize to other nucleic acid molecules, e.g., at least under low stringency conditions are said to be "hybridizable cognates" of the other nucleic acid molecules. Conventional stringency conditions are described by Sambrook et al., *Molecular Cloning*, A Laboratory Manual, 2nd Ed., Cold Spring Harbor Press, Cold Spring Harbor, N.Y. (1989) and by Haymes et al., *Nucleic Acid Hybridization, A Practical Approach*, IRL Press, Washington, D.C. (1985). Departures from complete complementarity are therefore permissible, as long as such departures do not completely preclude the capacity of the molecules to form a double-stranded structure. Thus, in order for a nucleic acid molecule to serve as a primer or probe it need only be sufficiently complementary in sequence to be able to form a stable double-stranded structure under the particular solvent and salt concentrations employed.

Appropriate stringency conditions which promote DNA hybridization, for example, 6.0× sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1–6.3.6. For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the present invention will specifically hybridize to one or more of the nucleic acid molecules set forth in SEQ ID NO: 1 through SEQ ID NO: 1096 or complements thereof under moderately stringent conditions, for example at about 2.0×SSC and about 65° C.

In a particularly preferred embodiment, a nucleic acid of the present invention will include those nucleic acid molecules that specifically hybridize to one or more of the nucleic acid molecules set forth in SEQ ID NO: 1 through SEQ ID NO: 1096 or complements thereof under high stringency conditions such as 0.2×SSC and about 65° C.

In one aspect of the present invention, the nucleic acid molecules of the present invention comprise one or more of the nucleic acid sequences set forth in SEQ ID NO: 1 through SEQ ID NO: 1096 or complements thereof or fragments of either. In another aspect of the present invention, one or more of the nucleic acid molecules of the present invention share at least 60% sequence identity with one or more of the nucleic acid sequences set forth in SEQ ID NO: 1 through SEQ ID NO: 1096 or complements thereof or fragments of either. In a further aspect of the present invention, one or more of the nucleic acid molecules of the present invention share at least 70% or more, e.g., at least 80%, sequence identity with one or more of the nucleic acid sequences set forth in SEQ ID NO: 1 through SEQ ID NO: 1096 or complements thereof or fragments of either. In a more preferred aspect of the present invention, one or more of the nucleic acid molecules of the present invention share at least 90% or more, e.g., at least 95% and up to 100% sequence identity with one or more of the nucleic acid sequences set forth in SEQ ID NO: 1 through SEQ ID NO: 1096 complements thereof or fragments of either.

As used herein "sequence identity" refers to the extent to which two optimally aligned polynucleotide or peptide sequences are invariant throughout a window of alignment of components, e.g., nucleotides or amino acids. An "identity fraction" for aligned segments of a test sequence and a reference sequence is the number of identical components which are shared by the two aligned sequences divided by the total number of components in reference sequence segment, i.e., the entire reference sequence or a smaller defined part of the reference sequence. "Percent identity" is the identity fraction times 100.

Useful methods for determining sequence identity are disclosed in Guide to Huge Computers, Martin J. Bishop, ed., Academic Press, San Diego, 1994, and Carillo, H., and Lipton, D., SIAM J Applied Math (1988) 48:1073. More particularly, preferred computer programs for determining sequence identity include the Basic Local Alignment Search Tool (BLAST) programs which are publicly available from National Center Biotechnology Information (NCBI) at the National Library of Medicine, National Institute of Health, Bethesda, Md. 20894; see BLAST Manual, Altschul et al., NCBI, NLM, NIH; Altschul et al., *J. Mol. Biol.* 215:403–410 (1990); version 2.0 or higher of BLAST programs allows the introduction of gaps (deletions and insertions) into alignments; BLASTX can be used to determine sequence identity between a polynucleotide sequence query and a protein sequence database; and, BLASTN can be used to determine sequence identity between between sequences.

For purposes of this invention "percent identity" shall be determined using BLASTX version 2.0.14 (default parameters), BLASTN version 2.0.14, or BLASTP 2.0.14.

A particularly preferred group of nucleic acid sequences are those present in the soybean insert of the clones set forth in table 6 below.

TABLE 6

| | Names of Clones Containing the Specified Gene | | |
|---|---|---|---|
| Line | Rhg4 | rhg1/frag 1 | rhg1/frag 2 |
| Forrest | Forrest 1 | Forrest 7 | Forrest 13 |
| Peking | Peking 1 | Peking 7 | Peking 13 |
| Pickett | Pickett 1 | Pickett 7 | Pickett 13 |
| PI84751 | PI 84751.1 | PI 84751.7 | PI 84751.13 |
| PI87631 | PI 87631.1 | PI 87631.7 | PI 87631.13 |
| PI87631-1 | PI 87631-1.1 | | PI 87631-1.13 |
| PI88788R | PI 88788R.1 | PI 88788R.7 | PI 88788R.13 |
| PI89772 | | | PI 89772.13 |
| PI90763 | | PI 90763.7 | PI 90763.13 |
| PI200499 | PI 200499.1 | PI 200499.7 | PI 200499.13 |
| PI209332 | PI 209332.1 | | PI 209332.13 |
| PI404166 | PI 404166.1 | PI 404166.7 | PI 404166.13 |

TABLE 6-continued

| | Names of Clones Containing the Specified Gene | | |
|---|---|---|---|
| Line | Rhg4 | rhg1/frag 1 | rhg1/frag 2 |
| PI404198A | | PI 404198A.7 | PI 404198A.13 |
| PI404198B | PI 404198B.1 | PI 404198B.7 | PI 404198B.13 |
| PI437654 | PI 437654.1 | PI 437654.7 | PI 437654.13 |
| PI438489B | PI 438489.1 | PI 438489.7 | PI 438489B.13 |
| PI467312 | PI 467312.1 | PI 467312.7 | PI 467312.13 |
| PI507354 | PI 507354.1 | PI 507354.7 | PI 507354.13 |
| PI423871 | PI 423871.1 | PI 423871.7 | PI 423871.13 |
| PI407922 | | PI 407922.7 | PI 407922.13 |
| PI360843 | PI 360843.1 | PI 360843.7 | PI 360843.13 |
| A2869 | A2869.1 | A2869.7 | A2869.13 |
| A2069 | A2069.1 | | A2069.13 |
| Jack | JACK1 | | JACK13 |
| Will | WILL1 | WILL.7 | WILL13 |
| Minsoy | Minsoy1 | Minsoy.7 | MINSOY13 |
| Noir | Noir1 | Noir.7 | NOIR13 |
| Hutcheson | Hutcheson1 | Hutcheson.7 | Hutcheson.13 |
| A1923 | A1923.1 | A1923.7 | A1923.13 |
| A2704 | | A2704.7 | A2704.13 |
| Essex | Essex1 | Essex.7 | ESSEX13 |
| A3244 | A3244.1 | A3244.7 | A3244.13 |
| Lee74 | Lee74.1 | Lee74.7 | Lee74.13 |
| PI437654 | | R107C17.7 | R107C17.13 |

Table 5 shows clones comprising rhg1 and Rhg4 sequences. The "Lines" column indicates the cultivar from which the sequence in the clone is derived. The Rhg4, rhg1/frag1, and rhg1/frag2 columns show the clones derived from the lines that have the Rhg4, rhg1 fragment 1, or rhg1 fragment 2, respectively. Rhg4 is amplified with SEQ ID NOs: 48 and 49, which produces a 3.5 kb product. rhg1 fragment 1 is amplified with SEQ ID NOs: 24 and 25, which produces a 2.9 kb product, and rhg1 fragment 2 is amplified with SEQ ID NOs: 26 and 27, which produces a 1.75 kb product. All fragments are subcloned into a pCR4-TOPO vector.

(i) Nucleic Acid Molecules Encoding Proteins or Fragments Thereof

A) rhg1

The present invention includes nucleic acid molecules that code for an rhg1 protein or fragment thereof. Examples of such nucleic acid molecules include those that code for the proteins set forth in SEQ ID NOs: 1097, 1100, 1098, 1101, and 1102–1115. Examples of illustrative fragment molecules include, without limitation, an extracellular LRR domain (rhg1, v.1, SEQ ID NO: 1097, residues 164–457; rhg1, v.2, SEQ ID NO: 1098, residues 141–434), a transmembrane domain (rhg1, v.1, SEQ ID NO: 1097, residues 508–530; rhg1, v.2, SEQ ID NO: 1098, residues 33–51 and 485–507), and an STK domain (rhg1, v.1, SEQ ID NO: 1097, residues 578–869; rhg1, v.2, SEQ ID NO: 1098, residues 555–846). Examples of illustrative nucleic acid molecules include SEQ ID NOs: 5, 6, 8–23, and 28–43.

B) Rhg4

The present invention includes nucleic acid molecules that code for an Rhg4 protein or fragment thereof. Examples of such nucleic acid molecules include those that code for the proteins set forth in SEQ ID NOs: 1099 and 1116–1119. Examples of illustrative fragment molecules include, without limitation, an extracellular LRR domain (SEQ ID NO: 1099, residues 34–44), a transmembrane domain (SEQ ID NO: 1099, residues 449–471), and an STK domain (SEQ ID NO: 1099, residues 531–830). Examples of illustrative nucleic acid molecules include SEQ ID NOs: 7, 44–47, and 50–53.

C) Rhg1 and Rhg4

In another further aspect of the present invention, nucleic acid molecules of the present invention can comprise sequences which differ from those encoding a protein or fragment thereof in SEQ ID NO: 1097 through SEQ ID NO: 1119 due to fact that the different nucleic acid sequence encodes a protein having one or more conservative amino acid changes. It is understood that codons capable of coding for such conservative amino acid substitutions are known in the art.

It is well known in the art that one or more amino acids in a native sequence can be substituted with another amino acid(s), the charge and polarity of which are similar to that of the native amino acid, i.e., a conservative amino acid substitution. Conserved substitutions for an amino acid within the native polypeptide sequence can be selected from other members of the class to which the naturally occurring amino acid belongs. Amino acids can be divided into the following four groups: (1) acidic amino acids, (2) basic amino acids, (3) neutral polar amino acids, and (4) neutral nonpolar amino acids. Representative amino acids within these various groups include, but are not limited to: (1) acidic (negatively charged) amino acids such as aspartic acid and glutamic acid; (2) basic (positively charged) amino acids such as arginine, histidine, and lysine; (3) neutral polar amino acids such as glycine, serine, threonine, cysteine, cystine, tyrosine, asparagine, and glutamine; and (4) neutral nonpolar (hydrophobic) amino acids such as alanine, leucine, isoleucine, valine, proline, phenylalanine, tryptophan, and methionine.

Conservative amino acid changes within the native polypeptides sequence can be made by substituting one amino acid within one of these groups with another amino acid within the same group. Biologically functional equivalents of the proteins or fragments thereof of the present invention can have ten or fewer conservative amino acid changes, more preferably seven or fewer conservative amino acid changes, and most preferably five or fewer conservative amino acid changes. The encoding nucleotide sequence will thus have corresponding base substitutions, permitting it to encode biologically functional equivalent forms of the proteins or fragments of the present invention.

It is understood that certain amino acids may be substituted for other amino acids in a protein structure without appreciable loss of interactive binding capacity with structures such as, for example, antigen-binding regions of antibodies or binding sites on substrate molecules. Because it is the interactive capacity and nature of a protein that defines that protein's biological functional activity, certain amino acid sequence substitutions can be made in a protein sequence and, of course, its underlying DNA coding sequence and, nevertheless, obtain a protein with like properties. It is thus contemplated by the inventors that various changes may be made in the peptide sequences of the proteins or fragments of the present invention, or corresponding DNA sequences that encode said peptides, without appreciable loss of their biological utility or activity. It is understood that codons capable of coding for such amino acid changes are known in the art.

In making such changes, the hydropathic index of amino acids may be considered. The importance of the hydropathic amino acid index in conferring interactive biological function on a protein is generally understood in the art (Kyte and Doolittle, *J. Mol. Biol.* 157, 105–132 (1982). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like. In making such changes, the substitution of amino acids whose hydropathic indices are within ±2 is preferred, those which are within ±1 are particularly preferred, and those within ±0.5 are even more particularly preferred.

It is also understood in the art that the substitution of like amino acids can be made effectively on the basis of hydrophilicity. U.S. Pat. No. 4,554,101, states that the greatest local average hydrophilicity of a protein, as govern by the hydrophilicity of its adjacent amino acids, correlates with a biological property of the protein. In a further aspect of the present invention, one or more of the nucleic acid molecules of the present invention differ in nucleic acid sequence from those encoding a peptide set forth in SEQ ID NO: 1097 through SEQ ID NO: 1119 or fragment thereof due to the fact that one or more codons encoding an amino acid has been substituted for a codon that encodes a nonessential substitution of the amino acid originally encoded.

Agents of the invention include nucleic acid molecules that encode at least about a contiguous 10 amino acid region of a protein of the present invention, more preferably at least D about a contiguous 11 to 14 or larger amino acid region of a protein of the present invention. It is understood that the present invention includes nucleic acid molecules that specifically hybridize or exhibit a particular identity to the nucleic acid molecules described in (i). See (a) above.

(ii) Nucleic Acid Molecule Markers and Collections of Such Molecules

One aspect of the present invention concerns nucleic acid molecules of the present invention that can act as markers. As used herein, a "marker" is an indicator for the presence of at least one phenotype or polymorphism, such as single nucleotide polymorphisms (SNPs), cleaveable amplified polymorphic sequences (CAPS), amplified fragment length polymorphisms (AFLPs), restriction fragment length polymorphisms (RFLPs), simple sequence repeats (SSRs), or random amplified polymorphic DNA (RAPDs). A "nucleic acid marker" as used herein means a nucleic acid molecule that is capable of being a marker for detecting a polymorphism or phenotype.

In one embodiment of the present invention, the nucleic acid marker specifically hybridizes to a nucleic acid molecule having a nucleic acid sequence selected from the group SEQ NOs: 1–1096 and complements thereof. In a preferred embodiment, the nucleic acid marker is capable of detecting an rhg1 SNP or INDEL set forth in table 2. In a preferred embodiment, the nucleic acid marker is capable of detecting an Rgh4 SNP or INDEL set forth in table 4. In another preferred embodiment the nucleic acid marker is a nucleic acid molecule capable of acting as a PCR primer to amplify an rhg1 or Rhg4 coding region. Examples of such primers include, without limitation, nucleic acid molecules having a nucleic acid sequence set forth in SEQ ID NO: 401–1096 and complements thereof. Such primers can be used in pairs to amplify a region (amplicons, e.g., without limitation, SEQ ID NOs: 54–400) that can be further investigated using techniques known in the art such as nucleic acid sequencing. Preferred pairs are those with identical "Seq ID" (see Description of the Sequence Listing) except for the fact that one "Seq ID" recites forward primer and one recites reverse primer.

In another embodiment of the present invention, the nucleic acid marker specifically hybridizes to a nucleic acid molecule having a sequence that is present on linkage group G within 500 kb or 100 kb, more preferably within 50 kb, even more preferably within 25 kb of an rhg1 allele, where the Rgh4 allele is preferably a sensitive allele, and more preferably a sensitive allele from A3244. In a preferred embodiment the nucleic acid marker specifically hybridizes to M5 a nucleic acid molecule having a sequence that is present on linkage group A2 within 500 kb or 100 kb, more preferably within 50 kb, even more preferably within 25 kb of an Rhg4 allele, where the Rgh4 allele is preferably a sensitive allele, and more preferably a sensitive allele from A3244.

As used herein, a "collection of nucleic acid molecules" is a population of nucleic acid molecules where at least two, preferably all, of the nucleic acid molecules differ, at least in part, in their nucleic acid sequence. It is understood, that as used herein, an individual species within a collection of nucleic acid molecules may be physically separate or alternatively not physically separate from one or more other species within the collection of nucleic acid molecules. An example of a situation where individual species may be physically separate but considered a collection of nucleic acid molecules is where more than two species are present in a single location such as an array.

As used herein, where a collection of nucleic acid molecules is a marker for a particular attribute, the level, pattern, occurrence and/or absence of the nucleic acid molecules associated with the attribute are not required to be the same between species of the collection. For example, the increase in the level of a species when in combination with the decrease in a second species could be diagnostic for a particular attribute. In a preferred embodiment of the present invention, the level, pattern, occurrence and/or absence of a nucleic acid molecule and/or collection of nucleic acid molecules of the present invention is a marker for SCN resistance.

In one embodiment, the marker is any nucleic acid molecule that specifically hybridizes to any nucleic acid sequence set forth herein. In another embodiment, the marker is a marker capable of distinguishing among the haplotypes of either rhg1 or Rhg4. In yet another embodiment, more than one marker is used to simultaneously distinguish more than one haplotype. In a preferred embodiment, two, three, four, six, eight, twenty five or fifty or more nucleic acid markers are used simultaneously. In another embodiment, one or more markers that are capable of distinguishing among the haplotypes of rhg1 and one or more markers that are capable of distinguishing among the haplotypes of Rhg4 are used together.

(iii) Nucleic Acid Molecules Having Promoter Sequences and Other Regulatory Sequences The present invention includes nucleic acid molecules that are an rhg1 or Rhg4 promoter or fragment thereof. Examples of such nucleic acid molecules include those set forth in SEQ ID NO: 2, upstream of coordinate 45163 and SEQ ID NO: 3, upstream of coordinate 46798. As used herein a promoter is a nucleic acid sequence that when joined with a coding region is capable of expressing the protein or fragment thereof so encoded. In a preferred embodiment the promoter sequence corresponds to between 500 nucleotides and 5,000 nucleotides or between 300 nucleotides and 700 nucleotides of the nucleic acid sequence set forth in SEQ ID NO: 2 between coordinates 45163 and 40163, or SEQ ID NO:3 between coordinates 46798 and 41798, or the nucleic acid sequence set forth in SEQ ID NO: 4 between coordinates 111805 and 106805 Preferred partial promoter regions include the TATA box region, e.g. at coordinates 44234 through 44246 of SEQ ID NO: 2 and at coordinates 107826 through 107835 of SEQ ID NO: 4, and CAAT box region, e.g. at coordinates 106243 through 106259 of SEQ ID NO: 4.

Other regulatory sequences include introns or 3' untranslated regions (3'UTRs) associated with rhg1 and Rhg4. In a preferred embodiment, an intron is selected from a nucleic acid comprising a sequence selected from SEQ ID NO: 2 (rhg1 v.1 at coordinates 45315–45449, 45510–46940, and 48764–48974), SEQ ID NO: 3 (rhg1 v.2 at coordinates 48764–48974) and SEQ ID NO: 4 (Rhg4 at coordinates 113969–114683). In another preferred embodiment, a 3'UTR is located within 5,000 nucleotides, more preferable within 1000 nucleotides in the 3' direction of the last coding nucleotide of either rhg1 or Rhg4 (SEQ ID NO: 2, rhg1 v.1, coordinate 49573, SEQ ID NO: 3, rhg1, v.2, coordinate 49573, SEQ ID NO: 4, Rhg4, coordinate 115204).

It is understood that the present invention includes nucleic acid molecules that specifically hybridize or exhibit a particular identity to the nucleic acid molecules described in (iii). See (a) above.

(b) Protein and Peptide Molecules

A class of agents comprises one or more of the protein or peptide molecules encoded by SEQ ID NO: 1097 through SEQ ID NO: 1119 or one or more of the protein or fragment thereof or peptide molecules encoded by other nucleic acid agents of the present invention. As used herein, the term "protein molecule" and "peptide molecule" mean any protein or protein fragment or peptide or polypeptide molecule that comprises ten or more amino acids, preferably at least 11 or 12 or more, more preferably at least 13 or 14 amino acids. It is well know in the art that proteins may undergo modification, including post-translational modifications, such as, but not limited to, disulfide bond formation, glycosylation, phosphorylation, or oligomerization. Thus, as used herein, the terms "protein molecule" and "peptide molecule" include molecules that are modified by any biological or non-biological process. The terms "amino acid" and "amino acids" refer to all naturally occurring L-amino acids. This definition is meant to include norleucine, ornithine, homocysteine, and homoserine.

One or more of the protein or peptide molecules may be produced via chemical synthesis, or more preferably, by expression in a suitable bacterial or eukaryotic host. Suitable methods for expression are described by Sambrook, et al., (In: *Molecular Cloning, A Laboratory Manual, 2nd Edition, Cold Spring Harbor Press*, Cold Spring Harbor, N.Y. (1989), or similar texts.

Another class of agents comprise protein or peptide molecules encoded by SEQ ID NO: 1097 through SEQ ID NO: 1119 or complements thereof or, fragments or fusions thereof in which non-essential, or not relevant, amino acid residues have been added, replaced, or deleted. An example of such a homolog is a protein homolog of each soybean species, including but not limited to alfalfa, barley, *Brassica*, broccoli, cabbage, citrus, garlic, oat, oilseed rape, onion, canola, flax, pea, peanut, pepper, potato, rye, soybean, strawberry, sugarcane, sugarbeet, soybean, maize, rice, cotton, sorghum, *Arabidopsis*, wheat, pine, fir, eucalyptus, apple, lettuce, peas, lentils, grape, banana, tea, turf grasses, etc. Particularly preferred non- soybean plants to utilize for the isolation of homologs would include alfalfa, barley, oat, oilseed rape, canola, ornamentals, sugarcane, sugarbeet, soybean, maize, rice, cotton, sorghum, *Arabidopsis*, wheat, potato, and turf grasses. Such a homolog can be obtained by any of a variety of methods. Most preferably, as indicated above, one or more of the disclosed sequences (SEQ ID NO: 1 through SEQ ID NO: 1096 or complements thereof) will be used to define a pair of primers that may be used to isolate the protein homolog-encoding nucleic acid molecules from any desired species. Such molecules can be expressed to yield protein homologs by recombinant means.

(c) Plant Constructs and Plant Transformants

One or more of the nucleic acid molecules of the invention may be used in plant transformation or transfection. Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. In a preferred embodiment the exogenous genetic material includes a nucleic acid molecule of the present invention, preferably a nucleic acid molecule having at least 20 nucleotides of a sequence selected from the group consisting of SEQ ID NO: 1 through SEQ ID NO: 1096 and complements thereof. In a preferred embodiment, the nucleic acid molecule codes for a protein or fragment thereof described in Section (i). In another preferred embodiment, the nucleic acid molecule is a promoter or fragment thereof described in Section (iii).

Such genetic material may be transferred into either monocotyledons and dicotyledons including, but not limited to tomato, eggplant, maize, soybean, Arabidopsis, phaseolus, peanut, alfalfa, wheat, rice, oat, sorghum, rye, tritordeum, millet, fescue, perennial ryegrass, sugarcane, cranberry, papaya, banana, banana, muskmelon, apple, cucumber, dendrobium, gladiolus, chrysanthemum, liliacea, cotton, eucalyptus, sunflower, canola, turfgrass, sugarbeet, coffee and dioscorea (Christou, In: *Particle Bombardment for Genetic Engineering of Plants*, Biotechnology Intelligence Unit. Academic Press, San Diego, Calif. (1996).

In a preferred embodiment, the genetic material is transferred to a soybean. Preferred soybeans to transfer an rhg1 SCN resistance allele are selected from the group consisting of PI548402 (Peking), PI200499, A2869, Jack, A2069, PI209332 (No:4), PI404166 (Krasnoaarmejkaja), PI404198 (Sun huan do), PI437654 (Er-hej-jan), PI438489 (Chiquita), PI507354 (Tokei 421), PI548655 (Forrest), PI548988 (Pickett), PI84751, PI437654, PI40792, Pyramid, Nathan, AG2201, A3469, AG3901, A3904, AG4301, AG4401, AG4501, AG4601, PION9492, PI88788, Dyer, Custer, Manokin, and Doles.

Preferred soybeans to transfer an Rhg4 SCN resistance allele are selected from the group consisting of PI548402 (Peking), PI437654 (Er-hej-jan), PI438489 (Chiquita), PI507354 (Tokei 421), PI548655 (Forrest), PI548988 (Pickett), PI88788, PI404198 (Sun Huan Do), PI404166 (Krasnoaarmejkaja), Hartwig, Manokin, Doles, Dyer, and Custer.

Transfer of a nucleic acid that encodes for a protein can result in overexpression of that protein in a transformed cell or transgenic plant. One or more of the proteins or fragments thereof encoded by nucleic acid molecules of the invention may be overexpressed in a transformed cell or transformed plant. Such overexpression may be the result of transient or stable transfer of the exogenous genetic material. Such overexpression can also result in SCN resistance to one or more races of SCN.

Exogenous genetic material may be transferred into a host cell by the use of a DNA vector or construct designed for such a purpose. Design of such a vector is generally within the skill of the art (See, *Plant Molecular Biology: A Laboratory Manual*, Clark (ed.), Springier, N.Y. (1997).

A construct or vector may include a plant promoter to express the protein or protein fragment of choice. A number of promoters, which are active in plant cells, have been described in the literature. These include the nopaline synthase (NOS) promoter (Ebert et al., *Proc. Natl. Acad. Sci.*(*U.S.A.*) 84:5745–5749 (1987), the octopine synthase (OCS) promoter (which are carried on tumor-inducing plasmids of *Agrobacterium tumefaciens*), the caulimovirus promoters such as the cauliflower mosaic virus (CaMV) 19S promoter (Lawton et al., *Plant Mol. Biol.* 9:315–324 (1987), and the CaMV 35S promoter (Odell et al., *Nature* 313: 810–812 (1985), the figwort mosaic virus 35S-promoter, the light-inducible promoter from the small subunit of ribulose-1,5-bis-phosphate carboxylase (ssRUBISCO), the Adh promoter (Walker et al., *Proc. Natl. Acad. Sci.*(*U.S.A.*) 84:6624–6628 (1987), the sucrose synthase promoter (Yang et al., *Proc. Natl. Acad. Sci.*(*U.S.A.*) 87:4144–4148 (1990), the R gene complex promoter (Chandler et al., *The Plant Cell* 1:1175–1183 (1989), and the chlorophyll a/b binding protein gene promoter, etc. These promoters have been used to create DNA constructs that have been expressed in plants; see, e.g., PCT publication WO 84/02913. The CaMV 35S promoters are preferred for use in plants. Promoters known or found to cause transcription of DNA in plant cells can be used in the invention.

For the purpose of expression in source tissues of the plant, such as the leaf, seed, root or stem, it is preferred that the promoters utilized have relatively high expression in these specific tissues. Tissue-specific expression of a protein of the present invention is a particularly preferred embodiment. For this purpose, one may choose from a number of promoters for genes with tissue- or cell-specific or -enhanced expression. Examples of such promoters reported in the literature include the chloroplast glutamine synthetase GS2 promoter from pea (Edwards et al., *Proc. Natl. Acad. Sci.*(*U.S.A.*) 87:3459–3463 (1990), the chloroplast fructose-1,6-biphosphatase (FBPase) promoter from wheat (Lloyd et al., *Mol. Gen. Genet.* 225:209–216 (1991), the nuclear photosynthetic ST-LS1 promoter from potato (Stockhaus et al., *EMBO J.* 8:2445–2451 (1989), the STK (PAL) promoter and the glucoamylase (CHS) promoter from *Arabidopsis thaliana*. Also reported to be active in photosynthetically active tissues are the ribulose-1,5-bisphosphate carboxylase (RbcS) promoter from eastern larch (*Larix laricina*), the promoter for the cab gene, cab6, from pine (Yamamoto et al., *Plant Cell Physiol.* 35:773–778 (1994), the promoter for the Cab-1 gene from wheat (Fejes et al., *Plant Mol. Biol.* 15:921–932 (1990), the promoter for the CAB-1 gene from spinach (Lubberstedt et al., *Plant Physiol.* 104:997–1006 (1994), the promoter for the cab1R gene from rice (Luan et al., *Plant Cell.* 4:971–981 (1992), the pyruvate, orthophosphate dikinase (PPDK) promoter from maize (Matsuoka et al., *Proc. Natl. Acad. Sci.* (*U.S.A.*) 90: 9586–9590 (1993), the promoter for the tobacco Lhcb1*2 gene (Cerdan et al., *Plant Mol. Biol.* 33:245–255 (1997), the *Arabidopsis thaliana* SUC2 sucrose-H+ symporter promoter (Truemit et al., *Planta.* 196:564–570 (1995), and the promoter for the thylakoid membrane proteins from spinach (psaD, psaF, psaE, PC, FNR, atpC, atpD, cab, rbcS). Other promoters for the chlorophyll a/b-binding proteins may also be utilized in the invention, such as the promoters for LhcB gene and PsbP gene from white mustard (*Sinapis alba*; Kretsch et al., *Plant Mol. Biol.* 28:219–229 (1995)).

For the purpose of expression in sink tissues of the plant, such as the tuber of the potato plant, the fruit of tomato, or the seed of maize, wheat, rice and barley, it is preferred that the promoters utilized in the invention have relatively high expression in these specific tissues. A number of promoters for genes with tuber-specific or -enhanced expression are known, including the class I patatin promoter (Bevan et al., EMBO J. 8:1899–1906 (1986); Jefferson et al., *Plant Mol. Biol.* 14:995–1006 (1990)), the promoter for the potato tuber ADPGPP genes, both the large and small subunits, the sucrose synthase promoter (Salanoubat and Belliard, *Gene* 60:47–56 (1987), Salanoubat and Belliard, *Gene* 84:181–185 (1989)), the promoter for the major tuber proteins including the 22 kd protein complexes and proteinase inhibitors (Hannapel, *Plant Physiol.* 101:703–704 (1993)), the promoter for the granule bound starch synthase gene (GBSS) (Visser et al., *Plant Mol. Biol.* 17:691–699 (1991)), and other class I and II patatins promoters (Koster-Topfer et al., *Mol Gen Genet.* 219:390–396 (1989); Mignery et al., *Gene.* 62:27–44 (1988)).

Other promoters can also be used to express a protein or fragment thereof in specific tissues, such as seeds or fruits. The promoter for β-conglycinin (Chen et al., *Dev. Genet.* 10: 112–122 (1989)) or other seed-specific promoters such as the napin and phaseolin promoters, can be used. The zeins are a group of storage proteins found in maize endosperm. Genomic clones for zein genes have been isolated (Pedersen et al., *Cell* 29:1015–1026 (1982)) and the promoters from these clones, including the 15 kD, 16 kD, 19 kD, 22 kD, 27 kD and genes, could also be used. Other promoters known to function, for example, in maize include the promoters for the following genes: *waxy, Brittle, Shrunken* 2, Branching enzymes I and II, starch synthases, debranching enzymes, oleosins, glutelins and sucrose synthases. A particularly preferred promoter for maize endosperm expression is the promoter for the glutelin gene from rice, more particularly the Osgt-1 promoter (Zheng et al., *Mol. Cell Biol.* 13:5829–5842 (1993)). Examples of promoters suitable for expression in wheat include those promoters for the ADP-glucose pyrosynthase (ADPGPP) subunits, the granule bound and other starch synthase, the branching and debranching enzymes, the embryogenesis-abundant proteins, the gliadins and the glutenins. Examples of such promoters in rice include those promoters for the ADPGPP subunits, the granule bound and other starch synthase, the branching enzymes, the debranching enzymes, sucrose synthases and the glutelins. A particularly preferred promoter is the promoter for rice glutelin, Osgt-1. Examples of such promoters for barley include those for the ADPGPP subunits, the granule bound and other starch synthase, the branching enzymes, the debranching enzymes, sucrose synthases, the hordeins, the embryo globulins and the aleurone specific proteins.

Root specific promoters may also be used. An example of such a promoter is the promoter for the acid chitinase gene (Samac et al., *Plant Mol. Biol.* 25:587–596 (1994)). Expression in root tissue could also be accomplished by utilizing the root specific subdomains of the CaMV35S promoter that have been identified (Lam et al., *Proc. Nati. Acad. Sci. (U.S.A.)* 86:7890–7894 (1989)). Other root cell specific promoters include those reported by Conkling et al. (Conkling et al., *Plant Physiol.* 93:1203–1211 (1990)).

Additional promoters that may be utilized are described, for example, in U.S. Pat. Nos. 5,378,619; 5,391,725; 5,428,147; 5,447,858; 5,608,144; 5,608,144; 5,614,399; 5,633,441; 5,633,435; and 4,633,436. In addition, a tissue specific enhancer may be used (From et al., *The Plant Cell* 1:977–984 (1989)).

Preferred promoters are those set forth in Section (a)(iii) of Agents.

Constructs or vectors may also include, with the coding region of interest, a nucleic acid sequence that acts, in whole or in part, to terminate transcription of that region. A number of such sequences have been isolated, including the Tr7 3' sequence and the NOS 3' sequence (Ingelbrecht et al., *The Plant Cell* 1:671–680 (1989); Bevan et al., *Nucleic Acids Res.* 11:369–385 (1983)).

A vector or construct may also include regulatory elements. Examples of such include the Adh intron 1 (Callis et al., *Genes and Develop.* 1:1183–1200 (1987)), the sucrose synthase intron (Vasil et al., *Plant Physiol.* 91:1575–1579 (1989)) and the TMV omega element (Gallie et al., *The Plant Cell* 1:301–311 (1989)). These and other regulatory elements may be included when appropriate.

A vector or construct may also include a selectable marker. Selectable markers may also be used to select for plants or plant cells that contain the exogenous genetic material. Examples of such include, but are not limited to: a neomycin phosphotransferase gene (U.S. Pat. No. 5,034,322), which codes for kanamycin resistance and can be selected for using kanamycin, G418, etc.; a bar gene which codes for bialaphos resistance; genes which encode glyphosate resistance (U.S. Pat. Nos. 4,940,835; 5,188,642; 4,971,908; 5,627,061); a nitrilase gene which confers resistance to bromoxynil (Stalker et al., *J. Biol. Chem.* 263:6310–6314 (1988)); a mutant acetolactate synthase gene (ALS) which confers imidazolinone or sulphonylurea resistance (European Patent Application 154,204 (Sept. 11, 1985)); and a methotrexate resistant DHFR gene (Thillet et al., *J. Biol. Chem.* 263:12500–12508 (1988)).

A vector or construct may also include DNA sequence which encodes a transit peptide. Incorporation of a suitable chloroplast transit peptide may also be employed (European Patent Application Publication Number 0218571). Translational enhancers may also be incorporated as part of the vector DNA. DNA constructs could contain one or more 5' non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., *Plant Mol. Biol.* 32:393–405 (1996).

A vector or construct may also include a screenable marker. Screenable markers may be used to monitor expression. Exemplary screenable markers include: a β-glucuronidase or uidA gene (GUS) which encodes an enzyme for which various chromogenic substrates are known (Jefferson, *Plant Mol. Biol, Rep.* 5:387–405 (1987); Jefferson et al., *EMBO J.* 6:3901–3907 (1987)); an R-locus gene, which encodes a product that regulates the production of anthocyanin pigments (red color) in plant tissues (Dellaporta et al., *Stadler Symposium* 11:263–282 (1988)); a β-lactamase gene (Sutcliffe et al., *Proc. Natl. Acad. Sci.(U.S.A.)* 75:3737–3741 (1978)), a gene which encodes an enzyme for which various chromogenic substrates are known (e.g., PADAC, a chromogenic cephalosporin); a luciferase gene (Ow et al., *Science* 234:856–859 (1986)); a xylE gene (Zukowsky et al., *Proc. Natl. Acad. Sci.(U.S.A.)* 80:1101–1105 (1983)) which encodes a catechol dioxygenase that can convert chromogenic catechols; an α-amylase gene (Ikatu et al., Bio/Technol. 8:241–242 (1990)); a tyrosinase gene (Katz et al., *J. Gen. Microbiol.* 129:2703–2714 (1983)) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a secretable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins which are detectable, (e.g., by ELISA), small active enzymes which are detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

There are many methods for introducing transforming nucleic acid molecules into plant cells. Suitable methods are believed to include virtually any method by which nucleic acid molecules may be introduced into a cell, such as by *Agrobacterium* infection or direct delivery of nucleic acid molecules such as, for example, by PEG-mediated transformation, by electroporation or by acceleration of DNA coated particles, etc (Potrykus, *Ann. Rev. Plant Physiol. Plant Mol. Biol.* 42:205–225 (1991); Vasil, *Plant Mol. Biol.* 25:925–937 (1994)). For example, electroporation has been used to transform maize protoplasts (Fromm et al., *Nature* 312: 791–793 (1986)).

Other vector systems suitable for introducing transforming DNA into a host plant cell include but are not limited to binary artificial chromosome (BIBAC) vectors (Hamilton et al., *Gene* 200:107–116 (1997)); and transfection with RNA viral vectors (Della-Cioppa et al., *Ann. N.Y. Acad. Sci.* (1996), 792 (Engineering Plants for Commercial Products and Applications), 57–61). Additional vector systems also include plant selectable YAC vectors such as those described in Mullen et al., *Molecular Breeding* 4:449–457 (1988)).

Technology for introduction of DNA into cells is well known to those of skill in the art. Four general methods for delivering a gene into cells have been described: (1) chemical methods (Graham and van der Eb, *Virology* 54:536–539 (1973)); (2) physical methods such as microinjection (Capecchi, *Cell* 22:479–488 (1980)), electroporation (Wong and Neumann, *Biochem. Biophys. Res. Commnun.* 107: 584–587 (1982); Fromm et al., *Proc. Natl. Acad. Sci.* (*U.S.A.*) 82:5824–5828 (1985); U.S. Pat. No. 5,384,253); and the gene gun (Johnston and Tang, *Methods Cell Biol.* 43:353–365 (1994)); (3) viral vectors (Clapp, *Clin. Perinatol.* 20:155–168 (1993); Lu et al., *J. Exp. Med* 178:2089–2096 (1993); Eglitis and Anderson, *Biotechniques* 6:608–614 (1988)); and (4) receptor-mediated mechanisms (Curiel et al., *Hum. Gen. Ther.* 3:147–154 (1992), Wagner et al., *Proc. Natl. Acad. Sci.*(*USA*) 89:6099–6103 (1992)).

Acceleration methods that may be used include, for example, microprojectile bombardment and the like. One example of a method for delivering transforming nucleic acid molecules to plant cells is microprojectile bombardment. This method has been reviewed by Yang and Christou (eds.), *Particle Bombardment Technology for Gene Transfer*, Oxford Press, Oxford, England (1994)). Non-biological particles (microprojectiles) that may be coated with nucleic acids and delivered into cells by a propelling force. Exemplary particles include those comprised of tungsten, gold, platinum and the like.

A particular advantage of microprojectile bombardment, in addition to it being an effective means of reproducibly transforming monocots, is that neither the isolation of protoplasts (Cristou et al., *Plant Physiol.* 87:671–674 (1988)) nor the susceptibility of *Agrobacterium* infection are required. An illustrative embodiment of a method for delivering DNA into maize cells by acceleration is a biolistics α-particle delivery system, which can be used to propel particles coated with DNA through a screen, such as a stainless steel or Nytex screen, onto a filter surface covered with corn cells cultured in suspension. Gordon-Kamm et al., describes the basic procedure for coating tungsten particles with DNA (Gordon-Kamm et al., *Plant Cell* 2:603–618 (1990)). The screen disperses the tungsten nucleic acid particles so that they are not delivered to the recipient cells in large aggregates. A particle delivery system suitable for use with the invention is the helium acceleration PDS-1000/He gun is available from Bio-Rad Laboratories (Bio-Rad, Hercules, Calif.)(Sanford et al., *Technique* 3:3–16 (1991)).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the microprojectile stopping plate. If desired, one or more screens are also positioned between the acceleration device and the cells to be bombarded. Through the use of techniques set forth herein one may obtain up to 1000 or more foci of cells transiently expressing a screenable or selectable marker gene. The number of cells in a focus which express the exogenous gene product 48 hours post-bombardment often range from one to ten and average one to three.

In bombardment transformation, one may optimize the pre-bombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment and also the nature of the transforming DNA, such as linearized DNA or intact supercoiled plasmids. It is believed that pre-bombardment manipulations are especially important for successful transformation of immature embryos.

In another alternative embodiment, plastids can be stably transformed. Methods disclosed for plastid transformation in higher plants include the particle gun delivery of DNA containing a selectable marker and targeting of the DNA to the plastid genome through homologous recombination (Svab et al., *Proc. Natl. Acad. Sci.*(*U.S.A.*) 87:8526–8530 (1990); Svab and Maliga, *Proc. Natl. Acad. Sci.*(*U.S.A.*) 90:913–917 (1993); Staub and Maliga, *EMBO J.* 12:601–606 (1993); U.S. Pat. Nos. 5,451,513 and 5,545,818).

Accordingly, it is contemplated that one may wish to adjust various aspects of the bombardment parameters in small-scale studies to fully optimize the conditions. One may particularly wish to adjust physical parameters such as gap distance, flight distance, tissue distance and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the art in light of the present disclosure.

Agrobacterium-mediated transfer is a widely applicable system for introducing genes into plant cells because the DNA can be introduced into whole plant tissues, thereby bypassing the need for regeneration of an intact plant from a protoplast. The use of Agrobacterium-mediated plant integrating vectors to introduce DNA into plant cells is well known in the art. See, for example the methods described by Fraley et al., Bio/Technology 3:629–635 (1985) and Rogers et al., Methods Enzymol. 153:253–277 (1987). Further, the integration of the T-DNA is a relatively precise process resulting in few rearrangements. The region of DNA to be transferred is defined by the border sequences and intervening DNA is usually inserted into the plant genome as described (Spielmann et al., Mol. Gen. Genet. 205:34 (1986)).

Modem Agrobacterium transformation vectors are capable of replication in E. coli as well as Agrobacterium, allowing for convenient manipulations as described (Klee et al., In: Plant DNA Infectious Agents, Hohn and Schell (eds.), Springer-Verlag, New York, pp. 179–203 (1985)). Moreover, technological advances in vectors for Agrobacterium-mediated gene transfer have improved the arrangement of genes and restriction sites in the vectors to facilitate construction of vectors capable of expressing various polypeptide coding genes. The vectors described have convenient multi-linker regions flanked by a promoter and a polyadenylation site for direct expression of inserted polypeptide coding genes and are suitable for present purposes (Rogers et al., Methods Enzymol. 153:253–277 (1987)). In addition, Agrobacterium containing both armed and disarmed Ti genes can be used for the transformations. In those plant strains where Agrobacterium-mediated transformation is efficient, it is the method of choice because of the facile and defined nature of the gene transfer.

A transgenic plant formed using Agrobacterium transformation methods typically contains a single gene on one chromosome. Such transgenic plants can be referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating, exogenous genes. Selfing of appropriate progeny can produce plants that are homozygous for both added, exogenous genes that encode a polypeptide of interest. Backcrossing to a parental plant and out-crossing with a non-transgenic plant are also contemplated, as is vegetative propagation.

Transformation of plant protoplasts can be achieved using methods based on calcium phosphate precipitation, polyethylene glycol treatment, electroporation and combinations of these treatments (See, for example, Potrykus et al., Mol. Gen. Genet. 205:193–200 (1986); Lorz et al., Mol. Gen. Genet. 199:178 (1985); Fromm et al., Nature 319:791 (1986); Uchimiya et al., Mol. Gen. Genet. 204:204 (1986); Marcotte et al., Nature 335:454–457 (1988)).

Application of these systems to different plant strains depends upon the ability to regenerate that particular plant strain from protoplasts. Illustrative methods for the regeneration of cereals from protoplasts are described (Fujimura et al., Plant Tissue Culture Letters 2:74 (1985); Toriyama et al., Theor Appl. Genet. 205:34 (1986); Yamada et al., Plant Cell Rep. 4:85 (1986); Abdullah et al., Biotechnology 4:1087 (1986)).

To transform plant strains that cannot be successfully regenerated from protoplasts, other ways to introduce DNA into intact cells or tissues can be utilized. For example, regeneration of cereals from immature embryos or explants can be effected as described (Vasil, Biotechnology 6:397 (1988)). In addition, "particle gun" or high-velocity microprojectile technology can be utilized (Vasil et al., Bio/Technology 10:667 (1992)).

Using the latter technology, DNA is carried through the cell wall and into the cytoplasm on the surface of small metal particles as described (Klein et al., Nature 328:70 (1987); Klein et al., Proc. Natl. Acad. Sci.(U.S.A.) 85:8502–8505 (1988); McCabe et al., Bio/Technology 6:923 (1988)). The metal particles penetrate through several layers of cells and thus allow the transformation of cells within tissue explants.

The regeneration, development and cultivation of plants from single plant protoplast transformants or from various transformed explants are well known in the art (Weissbach and Weissbach, In: Methods for Plant Molecular Biology, Academic Press, San Diego, Calif., (1988)). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of Agrobacterium tumefaciens and obtaining transgenic plants have been published for cotton (U.S. Pat. No. 5,004,863; U.S. Pat. No. 5,159,135; U.S. Pat. No. 5,518,908); soybean (U.S. Pat. No. 5,569,834; U.S. Pat. No. 5,416,011; McCabe et al., Biotechnology 6–923 (1988); Christou et al., Plant Physiol. 87:671–674 (1988)); Brassica (U.S. Pat. No. 5,463, 174); peanut (Cheng et al., Plant Cell Rep. 15:653–657 (1996), McKently et al., Plant Cell Rep. 14:699–703 (1995)); papaya; and pea (Grant et al., Plant Cell Rep. 15:254–258 (1995)).

Transformation of monocotyledons using electroporation, particle bombardment and Agrobacterium have also been reported. Transformation and plant regeneration have been achieved in asparagus (Bytebier et al., Proc. Natl. Acad. Sci.(USA) 84:5354 (1987)); barley (Wan and Lemaux, Plant Physiol 104:37 (1994)); maize (Rhodes et al., Science 240:

204 (1988); Gordon-Kamm et al., *Plant Cell* 2:603–618 (1990); Fromm et al., *Bio/Technology* 8:833 (1990); Koziel et al., *Bio/Technology* 11:194 (1993); Armstrong et al., *Crop Science* 35:550–557 (1995)); oat (Somers et al., *Bio/Technology* 10:1589 (1992)); orchard grass (Horn et al., *Plant Cell Rep.* 7:469 (1988)); rice (Toriyama et al., *Theor. Appl. Genet.* 205:34 (1986); Part et al., *Plant Mol. Biol.* 32:1135–1148 (1996); Abedinia et al., *Aust. J. Plant Physiol.* 24:133–141 (1997); Zhang and Wu, *Theor. Appl. Genet.* 76:835 (1988); Zhang et al., *Plant Cell Rep.* 7:379 (1988); Battraw and Hall, *Plant Sci.* 86:191–202 (1992); Christou et al., *Bio/Technology* 9:957 (1991)); rye (De la Pena et al., *Nature* 325:274 (1987)); sugarcane (Bower and Birch, *Plant J.* 2:409 (1992)); tall fescue (Wang et al., *Bio/Technology* 10:691 (1992)) and wheat (Vasil et al., *Bio/Technology* 10:667 (1992); U.S. Pat. No. 5,631,152).

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454–457 (1988); Marcotte et al., *Plant Cell* 1:523–532 (1989); McCarty et al., *Cell* 66:895–905 (1991); Hattori et al., *Genes Dev.* 6:609–618 (1992); Goff et al., *EMBO J.* 9:2517–2522 (1990)). Transient expression systems may be used to functionally dissect gene constructs (see generally, Mailga et al., *Methods in Plant Molecular Biology*, Cold Spring Harbor Press (1995)).

Any of the nucleic acid molecules of the invention may be introduced into a plant cell in a permanent or transient manner in combination with other genetic elements such as vectors, promoters, enhancers, etc. Further, any of the nucleic acid molecules of the invention may be introduced into a plant cell in a manner that allows for overexpression of the protein or fragment thereof encoded by the nucleic acid molecule.

Cosuppression is the reduction in expression levels, usually at the level of RNA, of a particular endogenous gene or gene family by the expression of a homologous sense construct Ig: that is capable of transcribing mRNA of the same strandedness as the transcript of the endogenous gene (Napoli et al., *Plant Cell* 2:279–289 (1990); van der Krol et al., *Plant Cell* 2:291–299 (1990)). Cosuppression may result from stable transformation with a single copy nucleic acid molecule that is homologous to a nucleic acid sequence found within the cell (Prolls and Meyer, *Plant J.* 2:465–475 (1992)) or with multiple copies of a nucleic acid molecule that is homologous to a nucleic acid sequence found within the cell (Mittlesten et al., *Mol. Gen. Genet.* 244:325–330 (1994)). Genes, even though different, linked to homologous promoters may result in the cosuppression of the linked genes (Vaucheret, *C.R. Acad. Sci. III* 316:1471–1483 (1993); Flavell, *Proc. Natl. Acad. Sci.(U.S.A.)* 91:3490–3496 (1994)); van Blokland et al., *Plant J.* 6:861–877 (1994); Jorgensen, *Trends Biotechnol.* 8:340–344 (1990); Meins and Kunz, In: *Gene Inactivation and Homologous Recombination in Plants*, Paszkowski (ed.), pp. 335–348, Kluwer Academic, Netherlands (1994)).

It is understood that one or more of the nucleic acids of the invention may be introduced into a plant cell and transcribed using an appropriate promoter with such transcription resulting in the cosuppression of an endogenous protein.

Antisense approaches are a way of preventing or reducing gene function by targeting the genetic material (U.S. Pat. Nos. 4,801,540 and 5,107,065 Mol et al., *FEBS Lett.* 268: 427–430 (1990)). The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes (Hiatt et al., In: *Genetic Engineering*, Setlow (ed.), Vol. 11, New York: Plenum 49–63 (1989)).

The principle of regulation by antisense RNA is that RNA that is complementary to the target mRNA is introduced into cells, resulting in specific RNA:RNA duplexes being formed by base pairing between the antisense substrate and the target mRNA (Green et al., *Annu. Rev. Biochem.* 55:569–597 (1986)). Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression (Takayama and Inouye, *Crit. Rev. Biochem. Mol. Biol.* 25:155–184 (1990)). An antisense vector is constructed by standard procedures and introduced into cells by transformation, transfection, electroporation, microinjection, infection, etc. The type of transformation and choice of vector will determine whether expression is transient or stable. The promoter used for the antisense gene may influence the level, timing, tissue, specificity, or inducibility of the antisense inhibition.

It is understood that the activity of a protein in a plant cell may be reduced or depressed by growing a transformed plant cell containing a nucleic acid molecule whose non-transcribed strand encodes a protein or fragment thereof.

Post transcriptional gene silencing (PTGS) can result in virus immunity or gene silencing in plants. PTGS is induced by dsRNA and is mediated by an RNA-dependent RNA polymerase, present in the cytoplasm, that requires a dsRNA template. The dsRNA is formed by hybridization of complementary transgene mRNAs or complementary regions of the same transcript. Duplex formation can be accomplished by using transcripts from one sense gene and one antisense gene co-located in the plant genome, a single transcript that has self-complementarity, or sense and antisense transcripts from genes brought together by crossing. The dsRNA-dependent RNA polymerase makes a complementary strand from the transgene mRNA and RNAse molecules attach to this complementary strand (cRNA). These cRNA-RNAse molecules hybridize to the endogene mnRNA and cleave the single-stranded RNA adjacent to the hybrid. The cleaved single-stranded RNAs are further degraded by other host RNAses because one will lack a capped 5' end and the other will lack a poly(A) tail (Waterhouse et al., *PNAS* 95: 13959–13964 (1998)).

It is understood that one or more of the nucleic acids of the invention may be introduced into a plant cell and transcribed using an appropriate promoter with such transcription resulting in the postranscriptional gene silencing of an endogenous transcript.

Antibodies have been expressed in plants (Hiatt et al., *Nature* 342:76–78 (1989); Conrad and Fielder, *Plant Mol. Biol.* 26:1023–1030 (1994)). Cytoplasmic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16:4489–4496 (1997); Marion-Poll, *Trends in Plant Science* 2:447–448 (1997)). For example, expressed anti-abscissic antibodies have been reported to result in a general perturbation of seed development (Philips et al., *EMBO J.* 16: 4489–4496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313–1315 (1997); Baca et al., *Ann. Rev. Biophys. Biomol. Struct.* 26:461–493 (1997)). The catalytic abilities of abzymes may be enhanced by site directed mutagenesis. Examples of abzymes are, for example, set forth in U.S. Pat. Nos.: 5,658,753; 5,632,990; 5,631,137; 5,602,015; 5,559,538; 5,576,174; 5,500,358; 5,318,897; 5,298,409; 5,258,289 and 5,194,585.

It is understood that any of the antibodies of the invention may be expressed in plants and that such expression can result in a physiological effect. It is also understood that any of the expressed antibodies may be catalytic.

(d) Antibodies

One aspect of the present invention concerns antibodies, single-chain antigen binding molecules, or other proteins that specifically bind to one or more of the protein or peptide molecules of the present invention and their homologues, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules.

Nucleic acid molecules that encode all or part of the protein of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal and may comprise intact immunoglobulins, or antigen binding portions of immunoglobulins fragments (such as (F(ab'), F(ab')$_2$), or single-chain immunoglobulins producible, for example, via recombinant means. It is understood that practitioners are familiar with the standard resource materials which describe specific conditions and procedures for the construction, manipulation and isolation of antibodies (see, for example, Harlow and Lane, In: *Antibodies: A Laboratory Manual*, Cold Spring Harbor Press, Cold Spring Harbor, N.Y. (1988)).

Murine monoclonal antibodies are particularly preferred. BALB/c mice are preferred for this purpose, however, equivalent strains may also be used. The animals are preferably immunized with approximately 25 μg of purified protein (or fragment thereof) that has been emulsified in a suitable adjuvant (such as TiterMax adjuvant (Vaxcel, Norcross, Ga.)). Immunization is preferably conducted at two intramuscular sites, one intraperitoneal site and one subcutaneous site at the base of the tail. An additional i.v. injection of approximately 25 μg of antigen is preferably given in normal saline three weeks later. After approximately 11 days following the second injection, the mice may be bled and the blood screened for the presence of anti-protein or peptide antibodies. Preferably, a direct binding Enzyme-Linked Immunoassay (ELISA) is employed for this purpose.

More preferably, the mouse having the highest antibody titer is given a third i.v. injection of approximately 25 μg of the same protein or fragment. The splenic leukocytes from this animal may be recovered 3 days later and then permitted to fuse, most preferably, using polyethylene glycol, with cells of a suitable myeloma cell line (such as, for example, the P3x63Ag8.653 myeloma cell line). Hybridoma cells are selected by culturing the cells under "HAT" (hypoxanthine-aminopterin-thyrnine) selection for about one week. The resulting clones may then be screened for their capacity to produce monoclonal antibodies ("mAbs"), preferably by direct ELISA.

In one embodiment, anti-protein or peptide monoclonal antibodies are isolated using a fusion of a protein or peptide of the present invention, or conjugate of a protein or peptide of the present invention, as immunogens. Thus, for example, a group of mice can be immunized using a fusion protein emulsified in Freund's complete adjuvant (e.g., approximately 50 μg of antigen per immunization). At three week intervals, an identical amount of antigen is emulsified in Freund's incomplete adjuvant and used to immunize the animals. Ten days following the third immunization, serum samples are taken and evaluated for the presence of antibody. If antibody titers are too low, a fourth booster can be employed. Polysera capable of binding the protein or peptide can also be obtained using this method.

In a preferred procedure for obtaining monoclonal antibodies, the spleens of the above-described immunized mice are removed, disrupted and immune splenocytes are isolated over a ficoll gradient. The isolated splenocytes are fused, using polyethylene glycol with BALB/c-derived HGPRT (hypoxanthine guanine phosphoribosyl transferase) deficient P3x63xAg8.653 plasmacytoma cells. The fused cells are plated into 96 well microtiter plates and screened for hybridoma fusion cells by their capacity to grow in culture medium supplemented with hypothanthine, aminopterin and thymidine for approximately 2–3 weeks.

Hybridoma cells that arise from such incubation are preferably screened for their capacity to produce an immunoglobulin that binds to a protein of interest. An indirect ELISA may be used for this purpose. In brief, the supernatants of hybridomas are incubated in microtiter wells that contain immobilized protein. After washing, the titer of bound immunoglobulin can be determined using, for example, a goat anti-mouse antibody conjugated to horseradish peroxidase. After additional washing, the amount of immobilized enzyme is determined (for example through the use of a chromogenic substrate). Such screening is performed as quickly as possible after the identification of the hybridoma in order to ensure that a desired clone is not overgrown by non-secreting neighbor cells. Desirably, the fusion plates are screened several times since the rates of hybridoma growth vary. In a preferred sub-embodiment, a different antigenic form may be used to screen the hybridoma. Thus, for example, the splenocytes may be immunized with one immunogen, but the resulting hybridomas can be screened using a different immunogen. It is understood that any of the protein or peptide molecules of the present invention may be used to raise antibodies.

Such antibody molecules or their fragments may be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or peptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

Having now generally described the invention, the same will be more readily understood through reference to the following examples which are provided by way of illustration, and are not intended to be limiting of the present invention, unless specified.

EXAMPLE 1

In this example, DNA is extracted from soybean plants, amplified, and mapped.

A single trifoliate leaf is collected from the newest growth of four week old soybean plants. Leaf tissue from the leaf is placed on ice and stored at −80° C. The frozen tissue is lyophilized, and approximately 0.01 grams of the tissue is used for DNA extraction. The 0.01 grams of leaf tissue is ground to powder in 1.4 ml tubes. 600 microliters (μl) of DNA extraction buffer consisting of 0.5M NaCl, 0.1M Tris-(hydroxymethyl) aminomethane pH 8.0, 0.05 M ethylenediaminetetra-acetic acid (EDTA), 10.0 g $L^{-1}$ sodium dodecyl sulfate (SDS), and 2 g $L^{-1}$ phenantroline (dissolved in 0.01 L ethanol) is heated to 65° C. (with 0.77 g $L^{-1}$ dithiothreitol added immediately before use) is added to each tube, and each tube is mixed thoroughly. The samples are placed in a 65° C. water bath for 15 minutes and shaken by hand after 10 minutes. The samples are taken out of the water bath and cooled to room temperature, and then 200 μl of 5 M KOAc is added to each tube. The samples are inverted and placed at 4° C. for 20 minutes. Samples are then centrifuged for 12 minutes at 6200× g and the supernatant (about 600 μl) is transferred to new tubes. DNA is precipitated with 330 μl of cold isopropanol and placed at −20° C. for 1 hr. The DNA is pelleted by centrifuging at 6200× g for 10 minutes and washed with 70% EtOH. The DNA is pelleted by centrifugation at 6200× g for 10 minutes and dried using a Speed-Vac. The DNA is dissolved in 100 μl of $TE_{0.1}$ (0.01 M Tris-HCl pH 8.0, 0.0001 M EDTA). The extraction will generally yield 500 ng DNA $μl^{-1}$.

A polymerase chain reaction (PCR) is conducted with 5 to 10 ng genomic DNA in 10 μl volumes of 10 mM Tris-HCl (pH 8.3), 50 mM KCl, 0.001% gelatin, 1.5 mM $MgCl_2$, 0.1 mM of each dNTP, 150 nM of each primer, 0.01 mM Cresol Red, 2% sucrose and 0.32 units of AmpliTaq DNA Polymerase (Perkin Elmer Instruments Inc., USA). For thermocycling, the Gene Amp PCR System 9700 (Perkin Elmer Instruments Inc., USA) is used with one step of 94° C. for 3 minutes, then 32 cycles of 94° C., 47° C., and 72° C. steps of 25 sec each and one final step of 72° C. for 3 minutes. The PCR products are run on a 6% polyacrylamide gel (30 cm×8 cm×1 mm) in 1× TAE (40 mM Tris-HCl, pH 8.3, 1 mM EDTA) at 180 v for 45 minutes. The gels are stained using SYBR Gold (Molecular Probes, Eugene, Oreg.) according to the manufacturer's instructions.

SSR primer screening for polymorphism is performed using PIC, HS-1, Will and PI507354 genotypes. SSRs that are polymorphic and easy to score (i.e., clear banding pattern and good separation between alleles) are mapped using the HS-1×PIC (F2) and/or Will x PI507354 (RIL) mapping populations. At least one SSR per BAC sequence is mapped. DNA markers that exhibited codominant banding patterns are scored as homozygous for one or the other parent or as heterozygous, exhibiting both parental alleles. Marker scores are checked for segregation distortion using the chi-squared test for goodness of fit to expected ratios. Linkage relationships are determined using Mapmaker Version 3.0b with a LOD of 3.0 (Whitehead Institute, Cambridge, Mass.).

EXAMPLE 2

DNA fragments containing candidates for genes rhg1 and Rhg4 from susceptible and resistant soybean lines are subcloned into a TA cloning plasmid (TOPO TA Cloning Kit, Version E, Invitrogen Corporation, 1600 Faraday Avenue, Carlsbad, Calif.).

Genomic DNA from 24 susceptible and 9 resistant lines is isolated using standard techniques. Approximately 500 nanograms (ng) of DNA is used for PCR amplification. Resistant BAC DNA is isolated by using AUTOGEN (Auto-Gen Corp., 35 Loring Drive Framingham, Mass.). PCR amplification is then performed using 0.1–0.2 ng of resistant BAC DNA. The primers that are used to amplify candidate rhg1 genes PCR are as follows:

Fragment I (2,892 bp) primer (SEQ ID NO: 25), GCA ATA CTT GAA GGA ATA TGT CCA C; primer (SEQ ID NO: 24), beginning at start codon, ATG GAT GGT AAA AAT TCA AAA CTA AAC; modified reverse primer 1 (SEQ ID NO: 1123), beginning 5 bp before start codon; GTT GTA TGG ATG GTA AAA ATT CAA AAC. Fragment II (1,746 bp) reverse primer 2 (SEQ ID NO: 27), ending at 13 bp after stop codon, GAC TGG CTG TGA CTG ATC TCT CT; primer 2 (SEQ ID NO: 26), CTC ACT TAC ACT GCT GAA TGC AGA.

The primers for Rgh4 PCR are as follows:

Forward primer (SEQ ID NO: 48), ATG TCT CTC CCC AAA ACC CTA CTT TCT CTC; reverse primer (SEQ ID NO: 49), ending at 2 bp after stop codon, GGT TAA CGG CAA TCC ATT GAA TCA AAG GAG.

PCR amplification is performed in an MJ Research PTC DNA Engine TM System, Model PTC-225 (MJ Research Inc, 590 Lincoln Street Waltham, Mass.). PCR is performed using the following components: 1μl DNA, 5 μl 10× buffer, 1μl primer 1 μl primer 2, 1 μl 10 mM dNTP, 1.5 μl 50 mM $MgCl_2$, 0.2 μl Taq. (Platinum), 39.3μl $H_2O$. The PCR program used is as follows: 95° C. for 10 minutes (step 1), 95° C. for 30 seconds (step 2), 70° C. for 30 seconds/−1° C. per cycle/72° C. for 3 minutes (step 3), repeat steps two through three 9 times (step 4), 95° C. for 30 seconds (step 5), 60° C. for 30 seconds (step 6), 72° C. for 3 minutes (step 7), repeat steps five through seven 34 times (step 8), 4° C. forever (step 9), end.

PCR products are separated on 1% agarose gel by electrophoresis. A single DNA band is excised from gel. Gel extraction is done using CLONTECH NucleoSpin Extraction Kit (Clonetech Laboratories Inc., 1020 East Meadow Circle, Palo Alto, Calif.). 2 μl of purified DNA is loaded on 1% agarose gel to check concentration. 40–100 ng of DNA is used for subcloning.

A TOPO cloning reaction is done according to the following: 4 μl of fresh PCR product, 1 μl Clontech Salt Solution, and 1 µl TOPO vector. The solution is mixed gently, incubated for 10 minutes at room temperature, and then placed on ice.

A one shot chemical transformation is performed as follows. 2 µl of the TOPO Cloning reaction is added to a vial of TOP 10 One Shot Chemically Competent *E. coli* and mixed gently. The mixture is then Incubated on ice for 30 minutes. The cells are then heat-shocked for 30 seconds at 42° C., and immediately transferred to ice. 250 µl of SOC medium is then added, and the mixture is incubated at 37° C. for 1 hour. 80 µl is then spread onto a selective plate, and 170 µl is spread onto another plate. The plates are incubated at 37° C. for 18–20 hours. The selective plates are LB agar plates with 100 µg/ml ampicillin, 40 µg/ml IPTG, and 40 µg/ml X-GAL.

After incubation, 8–10 white or light blue colonies are selected. The positive colonies are inoculated into LB medium containing 50 µg/ml ampicillin and incubated at 37° C. overnight. Sterilized glycerol is added to make 15% glycerol stock, which can be stored at –80° C.

Sanger sequencing reactions are performed on subclones using BigDye Terminators (Applied Biosystems, 850 Lincoln Centre Drive, Foster City, Calif.) and then analyzed on ABI 377/ABI 3700 automated sequencing machines (Applied Biosystems, 850 Lincoln Centre Drive, Foster City, Calif.). The sequences are evaluated for quality and error probability using the program, PBRED (Ewing and Green, Genome Res., 8:186–194 (1998), Ewing et al., Genome Res., 8:175–185, (1998)), assembled using the phrap assembler and viewed using consed (Gordon et al., Genome Res., 8:195–202). An rhg1 candidate gene is found in BAC 240017, and is about 4.5 kb in size. An Rhg4 candidate was found in BAC 318013, and is about 3.5 kb in size.

EXAMPLE 3

The physical mapping of a QTL (quantitative trait locus) is described in this example. Mapping is initiated with linkage analysis of SSR (simple sequence repeats) markers. Markers that are shown to be linked to the QTL of interest are used to PCR screen the soy BAC library and identify candidate BACs. Confirmed BACs are subcloned and sequenced, BAC-end sequenced, and fingerprinted. New markers are designed from good BAC-end sequences and used to screen the library, by either PCR or hybridization to high density grid filters, in order to extend the contigs. A BAC-end sequence and fingerprint database of soy BACs is used in conjunction with the above methods to help build and extend contigs. Sequenced BACs are aligned, and overlapping BACs are placed into contigs. These contigs, which contain unique sequences, are put into an ACEDB database, and predicted genes are annotated by hand using various programs. Candidates genes (for the gene of interest) are subdloned from genomic DNA of different lines by PCR using primers from outside the predicted coding regions. These subclones are sequenced and screened for SNPs (single nucleotide polymorphisms) and INDELs (insertions/deletions), and different haplotypes of the lines with and without the desired phenotype are examined for correlations between the haplotype and phenotype.

A single trifoliate leaf is collected from the newest growth of four week old soybean plants. The leaf tissue is placed on ice and stored at –80° C. The frozen tissue is lyophilized and approximately 0.01 grams of tissue is used for DNA extraction. The leaf tissue is ground to powder in 1.4 ml tubes and 600 µl of DNA extraction buffer [0.5M NaCl, 0.1M Tris-(hydroxymethyl) aminomethane pH 8.0, 0.05 M ethylene-diaminetetra-acetic acid (EDTA), 10.0 g L$^{-1}$ sodium dodecyl sulfate (SDS), 2 g L$^{-1}$ phenantroline (dissolved in 0.01 L ethanol)] heated to 65° C. (with 0.77 g L$^{-1}$ dithiothreitol added immediately before use) is added to each tube and mixed thoroughly. The samples are placed in a 65° C. water bath for 15 minutes and shaken by hand after 10 min. The samples are taken out of the water bath, cooled to room temperature, and 200 µl of 5 M KOAc is added to each tube. The samples are inverted and placed at 4° C. for 20 min. Samples are then centrifuged for 12 minutes at 6200× g and the supernatant (about 600 µl) is transferred to new tubes. DNA is precipitated with 330 µl of cold isopropanol and placed at –20° C. for 1 hr. The DNA is pelleted by centrifuging at 6200× g for 10 minutes and is washed with 70% EtOH. The DNA is pelleted by centrifugation at 6200× g for 10 minutes and dried using a Speed-Vac. The DNA is dissolved in 100 µl of TE$_{0.1}$ (0.01 M Tris-HCl pH 8.0, 0.0001 M EDTA). The extraction yields 500 ng DNA µl$^{-1}$.

The polymerase chain reaction (PCR) is conducted with 5 to 10 ng genomic DNA in 10 µl volumes of 10 mM Tris-HCl (pH 8.3), 50 mM KCl, 0.001% gelatin, 1.5 mM MgCl$_2$, 0.1 mM of each dNTP, 150 nM of each primer, 0.01 mM Cresol Red, 2% sucrose and 0.32 units of AmpliTaq DNA Polymerase (Perkin Elmer Instruments Inc., USA, 761 Main Avenue, Norwalk, Conn.). For thermocycling, the Gene Amp PCR System 9700 (Perkin Elmer Instruments Inc., U.S.A., 761 Main Avenue, Norwalk, Conn.) is used with one step of 94° C. for 3 min, then 32 cycles of 94° C., 47° C. and 72° C. steps of 25 sec each and one final step of 72° C. for 3 min. The PCR products are run on a 6% polyacrylamide gel (30 cm×8 cm×1 mm) in 1× TAE (40 MM Tris-HCl, pH 8.3, 1 mM EDTA) at 180 v for 45 min. The gels are stained using SYBR Gold (Molecular Probes, Eugene, Oreg.) per manufacturers instructions.

SSR primer screening for polymorphisms is performed using PIC, HS-1, Will and PI507354 genotypes. SSRs that are polymorphic and easy to score (i.e., Clear banding pattern and good separation between alleles) are mapped using the HS-1 xPIC (F2) and/or Will x PI507354 (RIL) mapping populations. At least one SSR per BAC sequence is mapped. DNA markers that exhibited codominant banding patterns are scored as homozygous for one or the other parent or as heterozygous, exhibiting both parental alleles. Marker scores are checked for segregation distortion using the chi-squared test for goodness of fit to expected ratios. Linkage relationships were determined using Mapmaker Version 3.0b with a LOD of 3.0 (Whitehead Institute for Biomedical Research, Cambridge Mass.).

Thirty-two BAC DNA superpools (10 genomic equivalents) extracted from either 4608 clones (48 96-well microtiter plates) are used as templates for the first round of PCR screening. Following identification of the positive superpools, the second screening is performed against 4-D BAC DNA pools. Each clone of the superpool is addressed 4-dimentionally (7×7×12×8) and pooled in each dimension. Each set of 48 plates is divided into 6 sets of 7 plates and one set of 6 plates, and partitioned in two ways. The first partition is in numerical order, plates 1–7,8–14, . . . 43–48 representing 7 group or stack pools. The second partition is according to plate position within each of the respective stacks, plates [1, 8, 15, 22, 29, 36], [2, 9, 16, 23, 30, 37, 43] etc., representing 7 plate pools. Each well of the 96-well plates contains 12 columns and 8 rows. Clones from row 1 are pooled from all 48 plates to generate the row 1 pool. Clones of rows 2, 3, 4 . . . 8, and columns 1, 2, 3 . . . 12 are pooled to generate 8 row pools and 12 column pools respectively.

For each superpool, BAC DNA is extracted from a total of 34 subpools (7+7+8+12). Positive clones are identified by TaqMan/PCR screening of the 34 subpools if one positive clone is present. If more than one positive clone is present in a superpool, a third round of screening with N4 PCR reactions is performed.

Addresses of candidate BACs are identified, and the candidates are streaked out for single colony isolation and grown overnight at 37° C. A single, isolated colony is picked and streaked out and grown overnight at 37° C. PCR is repeated for the marker of interest (using the program designed for the relevant marker) using a smear of cells from the plate streaked from a single colony. The PCR product is run on a 2% agarose gel and purified using the Clonetech NucleoSpin Gel Extraction Kit (according to the manufacturer's instructions, Clonetech Laboratories Inc., 1020 East Meadow Circle, Palo Alto, Calif.) and 10–50 ng of the purified DNA are added to 10 pmol of each primer (forward and reverse), in a total volume of 6 µl of ddH2O and 2 µl of BigDye Terminators (Applied Biosystems, 850 Lincoln Centre Drive, Foster City, Calif.). The cycling conditions are: 96° C. for 1 minute (step 1), 96° C. for 10 seconds (step 2), 50° C. for 5 seconds (step 3), 60° C. for 4 minutes (step 4), steps 2–4 are repeated for 24 cycles (step 5), and hold at 4° C.

The generated sequence is compared to the consensus sequence using DNA comparison software. Confirmed clones are subcloned, sequenced, BAC-end sequenced, and Fingerprinted.

BAC-end sequencing is done using 3.2 pmol of SP6 and T7 primers (separately), approximately 600 ng-1 ug of BAC DNA (Autogen prepped, AutoGen Corp., 35 Loring Drive Framingham, Mass.) reaction, resuspended in 6 µl of ddH20, and 4 µl of BigDye Terminators (Applied Biosystems 850 Lincoln Centre Drive, Foster City, Calif.) to give a total reaction volume of 10 ul. The cycling conditions are: 96° C. for 2 minutes (step 1), 96° C. for 15 seconds (step 2), 50° C. for 15 seconds (step 3), 60° C. for 4 minutes (step 4), steps 2–4 are repeated for 50–60 cycles (step 5), 72° C. for 2 minutes (step 6), hold at 4° C. or 10° C. (step 7).

The reactions are ethanol precipitated and loaded on capillary sequencers. The newly generated BAC-end sequence is trimmed from the vector sequence, and entered into a database containing approximately 400,000 BAC-end sequences. Each BAC is blasted against the database to search for BAC-end matches extension of the contigs. New markers are designed from good BAC-end sequences, and these are then used to rescreen the library in order to build up contigs across the region of interest. Screening can be done in either of two ways: as above (PCR strategy), or by hybridization of high-density grid filters from Research Genetics (Research Genetics, 2130 Memorial Parkway, Huntsville, Ala.).

The probes used for hybridization are derived from clones or genomic DNA by PCR amplification using the vector or gene-specific primers, with the appropriate cycling conditions. PCR products are run on a 1% agarose gel containing ethidium bromide (0.2 ug/ml) in 1× TAE buffer at 100 volt for 1–2 hrs. Isolated DNA fragments are excised and gel-purified using the Clonetech NucleoSpin gel extraction kit (Clonetech Laboratories Inc., 1020 East Meadow Circle, Palo Alto, Calif.), before labeling. In order to check the size of the fragments and concentration, 2 µl of eluted DNA plus loading buffer are loaded on a 1% agarose gel along with DNA markers of known concentration and size. All the probes used to screen the library are tested individually for repetitiveness, with a smaller filter spotted with random clones from the library along with some positive control clones according to the protocol described below.

The A3244 soy library generated by a an EcoRI digest is spotted on 3 high density grid filters from Research Genetics (Research Genetics, 2130 Memorial Parkway, Huntsville, Ala.). Each filter has six fields, twelve 384 well plates are spotted in each field in duplicate, with a total of 27,648 clones spotted on each filter. The plates are spotted in a 5×5 grid (12 clones per 5×5 grid) pattern within each field. Each clone is spotted in duplicate with a specific orientation within the 5×5 grid, which, together with the field position, gives information about its address. In a first round hybridization procedure, multiple probes are labeled separately and then pooled together to hybridize to BAC filters. Positive BACs identified in this procedure are deconvoluted by rehybridization with the individual probes.

A hybridization oven is set at 65° C., and Church Buffer (0.5 M Sodium Phosphate, pH 7.0, 7% SDS, 1% bovine serum albumin, 1 mM EDTA, 100 µg/ml salmon sperm DNA) is prewarmed to 65° C. Membranes are washed in 500 ml of 0.1×SSC, 0.1% SDS in a large container at room temperature for 5 minutes with gentle shaking (50 rpm) on a rotary shaker. The membranes are rinsed with 500 ml of 0.1×SSC (no SDS) for 1 minute. The wash solution is poured off, and 500 ml of 6×SSC (no SDS) is added to equilibrate the membranes. Three filters are placed in a tube. The filters are separated from each other and the sides of the tube by a layer of mesh. Each tube is filled with 6×SSC and shaken gently with the tube vertical to help eliminate bubbles between the filters and tube wall. The 6×SSC solution is poured off, and 25 ml of pre-warmed Church buffer is added. The bottles are rotated in a hybridization oven at 60 rpm and 65° C. for 30 minutes or longer.

Probes are labeled using 1 µl of 40–50 uCi/µl $[\alpha^{32}P$ dCTP], 50 ng of purified DNA in 49 µl of ddH2O, and Read-To-Go Labeling Beads from Amersham Pharmacia according to the manufacturers instructions (Amersham Pharmacia, Uppsala, Sweden). The probes are purified using the Bio-Spin Column P30 from BioRad according to manufacturers instructions (Bio-Rad Laboratories, 3316 Spring Garden Street, Philadelphia, Pa.). To 1 µl of the column-purified probe is added to a minipoly-Q vial (liquid scintillation vial) for each probe. 5 ml of scintillation liquid is added to each vial, and radiation activity for each vial is measured using a liquid scintillation counter.

After the probes are purified and counted for radioactivity, 10–20 probes and one control probe (from 50 µl reaction) are pooled with $10^7$ cpm/probe each, into one 1.5 ml eppendorf tube. The pooled probes are denatured at 99° C. in a sand heating block for 10 minutes. The tubes are cooled on ice or ice water about 2 minutes, and then spun down at 14,000 rpm for 30 seconds in microcentrifuge. The tubes are pre-hybridized in 25 ml of Church buffer for at least 30 minutes, which is then poured off. 40 ml of fresh hybridization solution (pre-warmed Church buffer) is added. The pooled-probe solution is added to the hybridization tube. The tube is rotated in the hybridization oven at 60 rpm, 65° C. overnight.

The probe solution is poured off, 30 ml of pre-warmed (65° C.) 1×SSC, 0.1% SDS washing solution is added to the hybridization tube, the hybridization tube is rotated in the hybridization oven (at 65° C.) for 15 minutes, and the process is repeat two times. At the last wash, the tube is rotated 180° and at the same speed for 15 minutes at 65° C. The washing solution is poured off, and 2×SSC (no SDS) is added.

Excess liquid is removed from each filter by placing the filter on a piece of 3MM paper. The washed filter is placed on developed film with the DNA-side up (the side BACs were spotted on), covered with Saran wrap, and squeezed to force out liquid and bubbles. The Saran wrap is folded to the other side of the film, fixed it with tape, and then dried Kimwipes. The wrapped filters are placed into a film cassette with the DNA-side up (the side BACs were spotted on), which is placed on BioMax MS film (Biomax Technologies Inc., Vancouver, BC, Canada) in a darkroom, and exposed overnight at room temperature without an intensifying screen. Film is developed with a film developer in the dark room the next day, and each film is labeled with filter number, probe used for hybridization, exposure time, and date.

Starting from Field 3, a 384-well grid is put on the field with the A1 position of the grid on the upper right, and the grid is aligned to the image. The row and column position for each positive clone on the BAC recording spreadsheet is determined and recorded. The pattern of the hybridization signal is matched to known patterns. There are 6 plate reference numbers for each of twelve patterns, which are arranged in the same manner as the 6 fields. Based on the signal pattern and field number, a plate reference number is determined for each positive clone. The grid is moved to the next field and the process is repeated. The original plate number (P) is determined using the following formula: $P=(N-1)\times 72+R$, where N is the filter number on which the identified clone is present and R is the plate reference number previously determined. The complete address of the identified clone is given by the original plate number plus its position on the plate determined previously. BACs' addresses are identified and converted to "imp" files according to a Q-bot file format.

24 working plates are loaded into a Q-bot (Genetix, Queensway, New Milton, Hampshire, United Kingdom) 6-high hotel and media-filled 96-well plates are placed on the deck. The Q-bot is run following the standard manual using the program called "Rearraying98" with the settings given in Appendix III of the accompanying manual: BAC-Picking. Plates containing picked clones are placed in a shaker incubator and grown overnight at 37° C. at 200 rpm.

35 μl DNA solution are transferred from 96-well plates into a 384-well plate using a Platemate such that 4 96-well plates of DNA are combined into one 384-well plate. The 384-pin head (puck) is washed in 10% SDS solution for 5 minutes, ultrasonicated in a water bath for 3 minutes, washed with 70% ethanol for 1 min., and air dried for 3 minutes. The 384-well DNA source plates and membranes are arranged on the deck according to the instruction from the manual and the spotted grid design chosen for the membrane. Spotting pattern are designed so that there is one control probe at each of the 4 corners of the membrane. An asymmetric pattern is used to orient filters. The control probe concentration is about 5 ng/ul. Zeus is run according to instructions. If the DNA concentration is lower than 5 ng/ul, the Zeus is run a second time to double the amount of spotted DNA on the membrane. One of the empty spots is spot dyed, if available, using one 384-well dye plate. If an empty spot is not available, it is printed on one of the DNA spots. This spot marks the position for cutting filters into small membranes (9×12 cm). Membranes are interleaved between 3M papers and left to air-dry. Each corner of each membrane is marked with a permanent marker and numbered. Filters are denatured on the surface of 3M paper soaked with denaturalization solution for 4 minutes, and then neutralized on the surface of 3 M paper soaked with neutralization solution for 5 minutes. The filters are washed with 2×SSC for 5 minutes and then air dried. The filters are then baked at 80° C. for 1 hr. and cut into individual small membranes (9×12 cm) according to the marked corner.

To confirm and deconvolute, hybridizations are done as before, but with newly generated filters, and each probe is done separately with a single filter using the smaller tube. 15 ml of Church buffer is used for the hybridization.

Fingerprints are generated by digesting the BAC DNA with Hind III for 3 hours at 37° C. and running the reaction on a 0.8% gel at 200V for 19 hours. The gels are stained with SybrGreen, while shaking at room temperature for 45 minutes, and scanned with a FlourImager. The bands are sized using Frag software and the fingerprints are assembled into contigs within FPC. Every time new clones are added the contigs are rebuilt using a tolerance of 10 and a cutoff of $10^{-9}$.

Subclones are generated and Sanger sequencing reactions were performed on randomly chosen subclones using Big-Dye Terminators (Applied Biosystems, 850 Lincoln Centre Drive, Foster City, Calif.) then analyzed on ABI 377/ABI 3700 automated sequencing machines (Applied Biosystems, 850 Lincoln Centre Drive, Foster City, Calif.). 7–8 fold sequence coverage is thereby generated across the BAC. The sequences are evaluated for quality and error probability using the program, phred, assembled using the phrap assembler, and viewed using consed, as in example 2. For Bermuda standard BACs, all contigs are ordered and oriented and all gaps are closed using a directed primer walking strategy. A final quality value of phred40 (1 base error in 10,000 bases) with no gap regions, double coverage or two chemistries across single stranded areas is achieved.

The sequence contigs are put into an ACEDB database along with soy EST and plant EST matches, along with Blastx, Tblastx, and Plant Blastn hits. Genemark.hmm is used to predict possible genes, and GeneFinder is used to predict splicing sites, ORFs, potential coding regions, as well as start and stop codons. The contigs are then annotated by hand and predicted genes accepted, edited, and modified based on the characteristics present in the sequence and matches to protein, nucleotide, and EST databases.

The high-density BAC library membranes used for hybridization are made by Research Genetics (Research Genetics, 2130 Memorial Parkway, Huntsville, Ala.), using a modified Q-bot (Genetix, Queensway, New Milton, Hampshire, United Kingdom), 384-well plates containing BACs are spotted onto 22 cm×22 cm Hybond N+membranes (Amersham Pharmacia, Uppsala, Sweden). Bacteria from 72 plates are spotted twice onto one membrane, giving 55,296 colonies in total, or 27,648 unique clones per membrane. The plates are spotted into six "fields" per membrane, with each field having 12 plates spotted in duplicate. This spotting format results in six fields with 384 grids in each field. Each grid is a 5×5 matrix containing 12 unique clones in duplicate, with the center position left empty. The two positions occupied by each clone in duplicate are designed to give a unique pattern that indicates the plate location of each clone. After spotting, the bacteria on the membrane are incubated for 8 hours on LB-agar plates containing 12.5 ug/ml chloramphenicol. The membranes are then denatured, neutralized, washed in a standard procedure, UV-light crosslinked, and air-dried. The membranes can be stored and shipped at room temperature.

Every reference, patent, or other published work cited above is herein incorporated by reference in its entirety.

SEQUENCE LISTING (1119 sequences)

SEQ ID NO: 1 - DNA, 127197 bp, Glycine max
  Clone ID: 515O02_region_G2
aagcttgaacagtatatggattagccaccatgttgaaaggcacgtaaggccaaatctcagcctttttccctgttgacttggccttctttaagaccttgtttggttccacataaccagttactgttactttctgctgcttcctgtttatctccaccgattctactcctacacttacaccaccattttttagttaatttcatcaccttcatacgtgttgaatgctatataattaatatatcacactattaattttcaccaaaagaaaaatattacactattaattgataacatactctctaacacttttgttttaacatattatttattattaattaaaatttattgaaaaccataaattataaattataagtgaaaccgtaaaataaagagtcatatcaaacattttttgtgattttcaacaaattttaacataaaagatggttgtgctagctttttttatatatattattataattataatatggcacactacccatggaagctgattttgagaataaaattgagggaaaacgtagcacttaccatctaatgaagagagagttttcctaaccttgagcacacagccgtcacaatccatcatcaccttcagctccacggtctgtaattgcttcttgttcttgttcttgttgttgtgttggtggttgccattcccacttcccattaaatcagaccagtaatctccaacccccatttttgtgtatttaatatcaaaaccaatatgaaagcaagctgggaagttcttgatgagtagagaaaattagtaggtattagatgggttgaacatcattgatggtgtgggagcgtaggagaagaatttatatagagaaaaagcaaggtccaaaaccacaagaagttacaaggaactttcttgcaaaacagaaaaatattcctcactcacttaccttctaatgatctaaaaaccaatgctgctctttgaagaacttttttttagttaccttgggatatttttaccacatctaactaaaattgattttggtagaagtaaaaattaatcttatttgttttaattttatcataattttaaaaataatttaaacgtacaaaatttagttaaaatcaagattaattcacatcagcatagtctaccagaattttgaaagttattcacacaattatatataggctttttcaccattcagattcaatgatatgaatggaaaggtatagtggtccctaactacgccagtgaataaagaaccttagaacggattataacttcttaacggagaaaatttttacgtggggttcaagaaagtagataagaaggaacgcattcctgtatcacctttttcattcgcaaatatatatgtaaatagtaaaaatttatggtactgcttgcggttcagttgacacttgacaaagttatttatttgatatgtaaaaagaaatggacatatcaaatgacagctaatactgagaactctcttattgaagagcaataatttattgaggacgaaagtgaaagactgaaagcagcttccaccgactcatgcacatatccgatcgaatgaacaacataatgtggaacagataatgacggggattgtatttgaagtgatgcaagtgcaagcatttagcaccattgacaaagataatccttcatattgcaacggctatgagccttttaccctctccattgataaaatttcagtcaacttaaggccaatcaaactcacaaatatatgtcaagtttgtactttgcaaaaagataataaggaaattatctatcaaactaaaataaaattcacaaaatcatcattccttagccagactcatgatccaaactcatatttttaattaaatttcagtcttctaacattaaggagttttcccatttttcttgattttaaaaagaaaatatttcaatcgtctctcttagcgataccctttggactcgttgtgacaatattcataacactttctcctaaaatctttcgacctttcactataaatacttgttaatgttatctaaaagtatgaagcattattttgtaagcaaattcttttagcttagtcacgaagaagttattggaagtgtcataattaatttcatcatgcatggttcaagaattccattagacaaagaaaattgtctcagtagttatcatcgataacacaagctactagaccaattgaccaaagaagtttcgtcttttaaattcttttcccatcttgtttgaatatgagatatttgattctcattgatactttttcgataagataaaggtgacattttggcttctgtttctaagatatttctataaagggaaccaaaagaagcaatttgaatcattaatttaactaacccactaaataatctttttttcaattagcaaaactgctgaaagctcagtcccacttttggaaaacaaaagtagagtgataaggaaaagataaaaataagaaaatgcaacgaaaagtgtgggtgagaacagaaaagagaagcatgcgtcaggataccaccctaaactaaagtatgtgcttaagttttgaagtaccggaggtatacaccaaaggcttagtttcatttgcattaacatattaataataattcacaagagaagaaatataaaataagataaatcaattttttcacaagttaaattttattttattttttggaatttttacaagaaataaaaaaattcataacttaaaattaactcatgtatgataactttttaatagtttttttgtttaattttcctaaaagataaggcgtataaattaattttagtttacgagagaagttggatttgtttatttcttatattaagtgccttgtttagaaatttattgaaagtgacccaaaatcaattatatgtggatttaaacacttcaaagctcgctgaaactgaaagcatttcattcaaaagtaaatttaacgttaatgttcccctgattagttgagaaaaggacatgaattgtactagtattaatttacctcgagatcaaagagagcaaaaagtttaatcatactatatttacgcagaaaaagatgataaacaagtgtatagtacagacgtgagacgtggaataaaactttgattagtaataaattggtcattgttgcttttagaaacttgctgtggacacacatgacaaaagggatttgcatttttatgaagctcgtctcatgtttaaactttaatttggacggaattgaaaaacatctcattgatatattcatgtgctttcttcttgctagcttttggattgtagatactctttgattatcataaaaggaacgaacgactttaatttggaaattgagaccgaagttgcaatagaaatcgttacacgtcttctctagtgtgtatgtattgtttccttttgggtttaaaggatgaccaaatgttgaggccagtcacaatataaagggaactcacgaagctggggaaagtgtttagtatagtttaatgtttaaactcatgcacgcaccagatatcttaagaatctataccagatatataacggttgtctatatagtttctttccattcccattgttggagaattaaagcttctgattatttagcatattttattgtataattttactatatagtattttgtactttaagtatcttatcaaatcttcggttgcaacatcattggagaagatatagtggcattcataatgaatacaagtccaatgaattcactttatgttgtcaactagtagtccaatgaattatgttgtggttggcttaagaatgaatacaagtcaaatttcagctggcttacagtcacagtggcatggaatatataacagagtgttgcgtcaaaaaaacaataatgacgacaacaggactaaatacaatgcatgtattttttttttaattgagaaataatttattctttaaagttctctaaaaaaagtaacattttactaataattttccccactcgaattgagggtattaaagtaattttcattgtttttgcttttattttttatttaaaaaacatttgttcagttaatgagattaatgaattttgtcacttttgggtaacacatgtaaaattgaagacggatgcagaaacaaacacctactaaatgacagtatatgaaacctttatatcaagtacatatattattttctcaattttctttaactttaactcattaagccaatcgatctattacatctcttactttgatttgatgtttcacttatcattaattaaagataaacaatgtattacattttcttaactaaaaattagcatctaagacatatatttttgtagttcattttgtcatgaaaaatatgggtacatcatccgatacaattactaaactaaactaagggaagaattattctcacttttatatttgttatttaaactatcaattctgaaatttctattttgcccactaaccaaattcctccaccccctctcttttcccttccctccttctcatatccaaaaccgttgcccctacaccaacctagactgcatcacccctccctcagcgccacccttctccccacacaaaacgtcgtcaatccacgaccacgccatccctccctccgcaacccattgtcaatccacatgcatgccatcctccccctccatgcaattcgttgatccacacagcaccttgccccatcaagatcaagcacccttgtttctcttttttggattttattgcaggttttgttgttgttgaatcgtatttctgttgcatcattttttacacgctactgtctgtaatggaaatagaatgaaatcgtatttcttttgcttttttttctttaccccatgtgtgcaacgaaaatagaattttgttagagacttatttaacggagtcatattttcgtgggaaggacaagctaaaaaaaaaatatttgaaactaagagggattgtgccaatagcaatattggtattgctagttcccctgaactacataaaaccttcctcgtattgaaatatgcttaattaaaactttcatacctgaaatatgggtgtcttcaaattattagctaatatttattttttttaatcaagtagttgaaaaaaaaattcagtttcattttattatttatttatttttcatcaagtggtaatatgacatacggagtgttgcctcaacctgtcttgttatggataactcatactcatgttatcatcttcgatgattgtgacaataacatgttggtaaattgaaacataaaaaaattttagataactatttgacaaaaaatgaatttttaggtagtaatttgaaaataatttattttccaggtatgaaaaacttaattaaatcaatctgaaaaataattttttagctaacaaatgataaggagaaattttataaaaataaataatttaatttcaaataaaatgataaattttattatttcattaaaaataaaaataaaaatggtaatcataaatttaagttatgtttaaaagtaaatcttataagtcaataagaaaaaattatttctcaaacacttttatttgatcaaatatttgtaagtttgtgtaaaaaactaaaaattaattaaaataacctgatgagcatatatgtaatttacttttatatagacttaaaaaactttatctttttttaagataatttctcattcaaaataagaaatacattaaattaatgagatatttttttatttgtagaattaaaaaaagtactatttgaaattcacaataacacttatcaatttatcatatttaatcagctgaactaaattaataaaataatattaaagattaaattaaaaagttgagttacatacattgaaccaacaagatcaaacactgagatatatattttggatccagagaataataaaggaagagtgaaggaaggcataacatgttacatacattgaaccaacaagatcaaacagtgagatattaattatttattgtttaaataaatttttaatacctgaaaaacatatcatttttaaattattacttaaaaaatcatttttttcaaatacctactagaaaaaaaaatttagttttattttattatgtcattaatcataatcacgtccactcggtcatatgtcattgaaagtgataacgtaacaataaaatattcgtgacaaggtgtgatgacgtaacattttgtatgtcacattatcatttcactaaagacaactaacaacaaataataaaataaaattgaattttttttaaaatacttaactttaaaaaataaatattaaataataatctaaaaatgatctgtatgtccattatcaaaaatttaagtaagccgaaatataaccttcttattcagtcattgtggattcgctaacaactcgtgctgatcgagcctatagtaattagctctcttagctagaaacattagcccctgattatcaatatgatgttcttgcacaaaacgacaaaatgatttcatgatttttagataaataagcgcaggattctctattattcagagcaattaaatgaacgcaattacgaggcagcaaatgcaaaatgcttcacatgaggctattggctatttaaaatttcactttgacatttttataattaattttgtctcaataattcgcatgacaattagcattaaaggttagctaaaactctaatttaaattgttacaatattttaaaaaaaactgagaaacatgatttaagttttgttattatatcaaatactactataaaatagaaaaaacttacacccttcaaatgtactagattcggattttttttatagaaaatattttaaaattaaatgtcatactcaacagtcaacacggtatttcacagtcccctagaatttcaaacaaaatcaaccaagtaacataaattagttgactgaaaaaatgaattaaattaaaaggcagtcatgggataacaccaggcatattaatttacataacctcacccgagcaaaagcgggtttaacagataatggtccagtacgtgttaggaatctaacatgctggcaatgtcaaaaaaataacagcattggatggtgtaagatctaaaatacttacaaagctaggaggaggacaaaatggatacatatttggatgtacatgtaataactctatctagacaggctagttgagatacataagaataagaacgtgtctgtctcagtaaagggcagacacaagtagaagtagaagaaacaaatagcagtgccaatgtacccggcacgatgaaatcatccgagatggagcagccgaaggtttgtggggagctcttccagcaacagctggagcaactgcatgcccgttcgttctttgttgctcatctgtaggcaatgggtttgatgaagtctcatttggagaaaggggcatcctcttgcctagactcagatcctgacctacagatgcatgtagactgtatataagcaaaaggaataaaaagggagacgggaagaacagtgttaaggtagaaaaaagcctttgcatcaagcaccaggcaaatggttaagagaccaagaactcacaagaagtcagcttcattgcctaagtagaatgattagaactaaagctaaaatatattagcttataaactcaaagtactatgactcacaatttgagcgtgaccacgctagcttcttgtttcccctatcaaataccaaacggtatcctgtcatgaagttctctgccaaaaaaatttattagttttaagatcaaagtatcttttaataccatattccagagtatgggtaatcagtagactttgataaggaaaatatttaacttacgtccgattgttcccatatctccttcagttggctgtatggctaaacaaaatccaatgactccctgcacaggaaggaccgatctaactaatttagctacaagccgacaactattcttataatgaagtctcttgtaacatctttaattatatgtcaaaattttagtccaggatcacttaattcacacccacctcattgccatagaatacaaatacggggtcatagaccacaaaactgttattctgttggaacgtgagagttaagctgggaacctttggcaactcttgcgaactgtctcagaaaagaataataaataaataaagccatcaaagagaccagaaaattctaccaattaggaaatcatgcaccaacgcaagagggaagagagacagagatctatccagaaaactcacctgggaacataacaatactcccaaggagatccttcaaagctagatcttgaaccatttacttgttgatcaaactatcacaaataaaatcatattaaaagactgagcagaaatttacattaatggaatttagaaaactaaagtacctcctcagctattgctccatacacatgaccaggaagaaaagtaaatgatgtcccgctatcaacctgcactttaaaacttgtcattttaagacaagaattcccaacacaacatgactccactccaataatgtaggttgaactgaccaggaaatttatcataattagcactgtgacaccattttctaaagtatattttagtgcagtgaaacattgtaaactaatttaaagtacagaatttcatactataatccatccaaaggcaagaatgaagtagactgttggatggttggtccctggtccccaaaaaatattctaccagaatcatcttcattaaagcacaaggaaaaagaatcgtggattaatcctgatttagcaagaaaacttggaactgaactctccccaggccccaaacctaataggccatctggagcaaccccatccaaataaccaccactttgcttcataccacacctgcattcaacaaaactgacgtcagagaaaaaaccaggaaacttgtttttaattaaaaaaagaatacatcatcagggaaagtgatgttgaagtaacaaagacagggcagtcagccacacccaagaacaactggagcctgaacagatgagtttgataaactgccgcctgactgaagatgcagtatgtcctcaaccaacaatccagaactcgacgtgttctccgacaagtaactgaccatgtatggacactgctgctgtgaacttttacaattcgaacccttatcacacaactgatgactgcaagatagatgcttactggataaggaccgagacggactatactcattcagatctctatcctgcataatagatgccccatatgtgaaggagcacctgccaatcaattactggaaataagtgctaaacctgttatagattctaaacctcattgaaccattacactcagaaaggaaccatgttttgtgttagtgtcacattaaactcgaattgaaaccttatccaatcaaggatttgcaattcgcatgattaactatttgttaaacaatcaataaaacaagctaatataatccgatattttattatttttattacatttaagatattgagactacaagttacatagtagagtaaaccaacattttagttcctgaaagtataaagcctagtcacataaacattagtccccaaaactaagaaacttcaaaaaagtccctgaagctgcaatccgccaatcgcattaatccaaagttataaaaaaatatgtgacttaatgataatattatcatatgtttaagagaccaaaatctcaagatgaaacaactagaaactccctggactaattttaaattttccttagtttgaagaactaatgtgacacctcgttatgcttaatcatagtttactctacatagtaagagaaatcaaagaaaaaaatagattaggtatgatattcataccagattggaatagtaactcgatgacaatggagcacactgtacgcaatcacacggaatccaaaggagatcactccctgcgtccaacgccacgagaaacgaagtgctcggtgttcctatatcaatccacgtgtaatgcaacctaatcaccagagacgcattatcagattcaaaccgaagaaaagggagcaattagggattattattattattattattattattaccagccgaagtcgttgccgagcgacatcgttttgctaccgtgagaaggaaacagtagctggtagcgtgcgcctccgactttgatcttgcgccggagaatgtcgccggtgagaagcatccggtagtagcccatgctccaccggtccggccagtatccggtcggaggccgaaccggtttcatttcgtcggcgaagcggtgaacgaggcgggcggaaaacgtgatcggaaccggcattgcgcgagccgttaccaaaagcaacaaaagcagcaaccgccaccgcatcgagatcgagatctggcacttgcacttattctgatgcctcgttttaactgatttaagtaacgattagtgttaattagtgaggtgagggtgcgcagtgtgcatcatcatcgccatggatcgtatcgtttcgtccctgtgtggctgtgtgtgagtgagagtgagagtgagagtgagggtggataaaacaaacaaacaaaactagcgcattttgttgcgggtggaattagactgttactaagtgcttaattaatggggaaaggaaagtggtatgattagtgtttgtaacagtaagtgattattgtaaatgatgattaggaggaataagggtgcaacactgcagcgacgaagcgaaacgtcacgcgcggtggccccaccatgtctttacgtgcttgagaatgaaacggccttttattgccgatgtcgatttgtctttgccactgtgggcccccccacatttattattattcctttccttttacgaaataaaaaataaaaaatcaaacaaacaaggcaaaaggtttcttaagtatttagtttcattatataaataaaataaatgcctagatctagtaaataatcacattatgtggtgtgggtcaggaataaagcttcacacacgaaaaaagaaatcttgcaagtaaacagctgaacacattaattgtttttaaagaaatctaaagttattgaagaaaacaactgagacatgataatttgactaattaatacttttagtgaaggagacgtattttaaaagataaagtataattataataataattaataaaataaataacgattaatatttagtaatttcattctatgtaatattagtatgatctcaactcaactgataattttcaagataatagttataattgcactctgtggaatcttaagttctttctccaaagaaaaaaaaaaacattttttcttccccttgtcgtgttctcttattctgccatctccaattctgttcacaatcgtaggttgtgccgccaatgatgtttaatgataaagatcaaatacgtttgcaatgaatcgggatgacaagactgagacaaccaataggtgaagctaaccaatgcacaagtgctccaatcaataaaacaggcccaaaaaggtggggtggtccaaaatgtgaaggtaagtttaagtagggtgttcacgccttggattgcgtctgtgtaaatccgtcacccaatccaaacaaaaaatattggatggatttgtgtgtttttctttttaaatcgacctaatctgatcatgaatgaatttgatcgagatggatttgttattaaaaaaagttcaaaaataattttcttaaattttttaaaatattttttagaatttacaatacaattacttgtaatatagttgcataaaaaaaattaaccaccaatttcaatgcacatattaactgcatcataaaatcaaattgaaaacaagtaaccaacaaacatttaatttataaagcaaataatactaaatcaaatttcaaccataaagcagataacaaattgtcttgaaaacttagtaatcttataaagtacacactagtacaaaataaacttaaaatcatcccaaaaaatatataatactacaatagaaacactgcaatatagtgataatgtcagacaattgctcaaccagccaacctcacacatagaaacacggtaagcaaaagatcaaaatcaattattatactaataataaatttaaattatgctatgcagaaaaaagaaatatgccaaaaaagaaatcatatcataaactaagttaaaaatattaccttaagaactaatagtcctaactcccaatactaatactcctaagaatagtccaagtagtaatcctaacactaacattatttaaagtcaaaccatacaactttaaaaaatgttttaaaaagttcatcataacataatatcaatttatattcatattgtaaacaaacggaaaaaaaaaaagaaactattattgaatacctagttccatcttttttgtttcatctaattcaactcgtaaatcaccgacattttgcttattagttttgagtcaattttgggtacaaatcaaagcttcaacagtaatgggacttaaagaactacaaaaatggatcaagcactcaaccttttgtactaaatgcagactcaaatgacacaatagacataagaatgaccaatatatctctagccatgaaagaaataacatgatatttggatgctttcattttccaccatgccaaaatgtcaaatccaagaccgtcatcttcattgtcatcctttaaatacatatccaactcactcctttgctattcaccacattttttattcattttcaatctaaattggtcgtcccaatcctcatcctcatcaacatcgttggcattaccttgtgaagcatggtatgaagccaaagtactagaattactactatcaatggaaataggatgttctgaagcatattcaacaaacatttttcttataagatcatccaattttttcagcatctctttggtttggtcaacaccatgcattttcttaaaacaaaactcaatataatcaaatttataacacagatcaagaaaagcagtcacaaataaaagatagctaatctgatcactctctcaatacttgttaaacttgagttgcatattagttgtctcttttgtatcaccggatcatcctcatgcctccatctatttaggcatttctgaatagtaaccaacttcttaaagaaattcttagctgtaacatgtagtgacccagaaaaaaaaattgcatcatagaaaactttcaaaaaactcacaaacacacgagcatgtttctaatccatctctttaggacatcctccttcactatttagaagagtgagcacatatgcagcctcaacatactcataacgattgaaagcttgttcaaattttcagcaacatctaacatcaaataagtggagtgacccagaaaaaaaaattgcatcatagaaaactttcaaaaaactcacaaacacacgagcacgtttctaatccatctctttaggacatcctccttcactatttagaagagtgagcacatatgcagcctcaacatactcataacgattgaaagcttgttcaaattttcagcaacatctaacatcaaataagtggagttccatctggttggcacattaagtgttagcattgcctttgaatttacactaacgtcctccgcacacctctttaaagtagtcaacctacttggagaaaacctcacaaacttacatgcaacctttattttactaattgaagagtcaatttccttaaacccatcacatacaatcaaattcaaaatgtgtgttgttaactcattggcaagtggactaaattgtcacaagtaataaaataaaataaaagtctgagtatcaagtccacaggagctttatttgtacttaaattaatgtaaacccaaattttcaaacaagagataaagaattgagagtgaaaagttaaagggctagtaaaaggcaagaagataagaaaataaacaataatttgaatgcaaaacatgacttcaaaatgcaattgtgttgaaacttagcatgccaaaactacttgtgctacaatgttaatattttttctctatctaatattatccccgtgtttactcgcatttactatgatattctatctttggaaccccgcatcaagagcctaatttatctattttttctcccaaattcctttgcaaagataaaatagtaaatcatattaagattaaagatgtatgaaataagctaaacaaacatcattctattcctagacatgatttcatttagatgttctttcccaattctctaggaaacaaccattttcaaatgcattatctcctaaacaatacatgagcatgggtgattaaaccacaatcaataataataaagcacataaaagaacaatagaactgaaattgcattaaataaatagtaaggaagagttacattacaagagtttggtctatcaggctctcaacaatgaggggtttagcctctaccatgagagactttacactttaagggttgatggaggtaaaagaagaaaagggatgaataaagaaagagaaggagagaatggttatagaaggagggtttcccctattagagatgttcaggctttgggtgtattcaagagagagttctaagtttcggtgtgtctttctccttttgcttaaggtagcttaaaattcacacgatctcacgctaagagcgcccttctgggcttagcaggtatggcggtgatcacgcactaagtgcgacggcatctgggcttagcgagtatggtagcaagcacgcacttagcgcgagattcacactaaacgcgcctttgggcttcttcatgaatcttcttcacgctaagcttgatctgactactaagtgagacgacgcgctaagcctttcttgtatgctaaacaagctgtctccatcttcaattttttttcaagactttttcttcacgtttttgcatcaattttttctccggcacttgtaatttccttcttttgaatcttgctgatcaagaatcaaaatgatattaaaatcctcattatttcattgaaaacaacagtaaagtagaggaattcttagtcaaaattgactatcaattaaacccaaatttcccagttatcatgtgctgaacgctgcatatgtataaactcttcattcaacaaagtatgatcatttcaaacactaagacctctacttaaatatgaaatggctacactgttagcacttgcattatcaactgttatacaacaaattttttgaatccctcattctttcaggcaattctctagggctatccaagtggtttcacctttgtggtcaccaatcaaacaaaattttagtattttcttatgcaacctaaatacttcatcaatgtaataagttgtcacacacatgtaattcacattttggattaatgtccatgtatcaattgtaagtgaaaccattgtttatttgcaaacaatatgcattccaactgcttttcattattaaacacttgaatgcaatatctagcaatagtcacatgagaagaaatattaaaataaggttgagccacttccataaacttcctaaacctttcatattcaacaaatttaaaagaaagttcatttgtaatgatcatctttgcaagttctataatagttctctcttgattgaaatcaacaaatttcacactaagagcattagggtcaccctcacatttctttccaacaataattgtttttttatttctcatcaacctgcctaaagggtttttcatacatgaagctaaatgtttgttcaagtttttggttccatatttagaactattagccttatagcattttttacaatacttgcaaaaggcatcattatttaccctatcaaaatgattccacacttcagaaggggatcaaatagagcttgcgacccttgttgtgtgggaacctccagcacttgttttgttttgattgtgatggagcaccagctgctacaggttcagtaggggacattgagagggagtaaacggtggcaaaggacttaagacattgacacttccaataaaacttctattttccatttgtcaaatttaataatttaacaaccgtcaactacaagtctacaacgtgtatcatataaaaaataatgaataataatataaatacaactatatattttttcttaagtgaataacatctacaaattacactcaaatgagtcacttaagcataattattaatacaactatatattttcttatgtggcaagaacattatactttgtttagagttgtacaaatacttacttagtagtagacaagtgactaggaattttattaccaagaacttattccacaaatccaaattccaaattcatgttctaacctctaacaactatatatatattccttgtcatttgatgagtatgctttgatttcctatggaatctcatctttgtctctaatttgtattcattgaaactcttgaattagaaaagccacatgtacctagtatcatttgatcataattcatatccttatgtgatccaaattttctttgctaataatgttatttaaaacatgtactatctctttatttctacatcaaccaagaatgtatttcttgatattcataccagatttttgtcacactgttccccacagtgatagttcctaaatataattttttatgagtcgaagacaaataaaaaaccacatttataacaagcaatacaaacaaagcagtcacaatatagcaatctatcatatgctgtaagagaatatcaggaaggtaatcataaaatgagataaaggctgaataatttgtaaaatatctccacctagagagtataagtacagattttaataaccacatcaaaagaataaaaaaaaaattatgtttcagacacattcaccacagtgatggtttcttaaaaaaaatcatctatcgattcatatgtaccaattattaatacaataatgcagttaaatatgcagtaagcattttgtctaccagtgccatgtagacgtaggagagtgacagagaggttgcggcagcatcgccggcgtagcgcagtcgcgcagagagattgagagaggatggagatgcgaagcgccaaagagaaaggcggagcagagacctgagaaaggacgcagtcacgcagtcgcacaaccgcgagggaggaagaggcggagcgagcgcaacggcgcggagggacggagatgcgaagcatcagagagcgaggtggagcggagaccttagcgctgcgacgacggtgaacaaagaggccgagtgcagtggcgcggaaggagggccggaccgtcggagggagacgcggagtcggagtagtcgagtagacatagtggggggcgatatcgcgataggatttatcctctgggaggaataattaattaattggtaatatattattttttttataatattaatttattatataaaggtttcatcggactcggtattatgtaacccgtcccgaatatgattaggttttataaggttggattaggtttgattcaataaaaaaaacttatccaaattaattgggttagattggatcattggattatttgtacataagtttaagaacataatcgatggaatttgacaattcatgaagggtatttaggcaatgtttgtctaggttttctttcttttttttattttgtaaaaaaaacattttgcttaatattttttccttaatgattagtaatataaaatataaaaaaatgttagcaacacactctttttaacacatatttttccattggttaaaaattattaaaaactacaaaaattagaagaaaaaattattaaataagaaatgagactcacaaaaatttataaattttaataaattttaactaataatagtgttattaacatttctggatatagagattaatgaggggttttctaatcttttctttattaaaaaaatatgatgtaaaggtctaaatttatagtcctcatgtaaatcacgtgtgtgtatttggaaaatattcaagtatctattagagctatctatataatacggtggagtggagttgagtcatatagcctctcacctacaatgactaggactctcgcaaatattggtgcgcaaactccttgcttctgtatttttagagaacgagaggtaatatatgatccatccatgagtatgcgaattgggaatgatgcatgattttgctcatatcaaagggggagaggggtgacgactaatatatcttatagttaaatagataaaatgttttgatttttgtgatatttttttaacaataatcgttgaatatcaaaaacttattattatttttttaggacgaggaaggtgctgtaaatgaaaaggaagtaataaattgaagtttatcaaaaccaatgctttcggcttctgaaatacgagatctacataaagacaattctaatgaatgttatgaagagtttgattggaaaatcaatggcaaaaggaagaaaatttattaactcgatgtaattaaaattggtgaaataataaaatctatattaaaaaaaaattacgcaatagctcttgaaacgaatccccaacaaacgatatgaatttcatgtagaaatttggtactttgatacagaaagaggcaaaatgaaatgattttgtcattttgagctttgatttattagtagaaaaccgttccaaattctgaattgccaaattttgggaaaatggtaatccagattgatcttttgtgtgagtgtggtgatcttgaatgttcattaagagctaatcattaatagtatttatttatcacacacaaaaaaatcttaaatatactcctataaatatttatatataaacaaggcactttaaattgacaacgtgcaaaaatcatacaggattcgtagcagacctaatcttcgtgtgcccctaggcatttaacctagggaaccaaggatcaagttacaaaagaatattattttaaaagaatttgtttgggactatatagaccaaagaacaaataactgtggctatgtacactagcaagataaataatacaaaatttagacaaaaatttcttttcaaccatgtatcctgttttccaatttcaaagctgtcactaaagacagaaacgggtatcacttgttagaccactgaaattctatttctaaattcctcgagggtccacttttactttccggcaacagagtgtactctccagatactgcacctagcattactacccgatcaatctggattgtcactttcccaaatgaactctgtggtcagataaaaaaaaaatagatgggttaagcggaagcctaaaaccaaaataactgaagatggatagactgcatttacaagtccaatttttccacaattacctttcccattttgctcttgtttttgcaagaaatgtgaagcttttggccttttggaggactctcaaaggaccatgtaaagctctcatcccactccggattagggccagttgagaccacctgatcagcacattctcatggtaattagcacattcactttccgagtaggaaatcacatcaaaatagaaagaaaacatgattttccacgaattgtatattgtgataaccacagattcagaatgcaaatcattgtcccttgcgtttaaaacaatagaaaagaaattgaagtgggtgtggctcttggcaagtgagaaccatatacttccgtatcaatattgtaacaaatcgcatttaagtcaaaagctacttcaaaaggaaagaaaaaaacaatttgggtgaatctggattctaaagtctggcaacagaactgcaatggaatatgtaatagtcaactggatttttttttctaggaagtagctataaaggtctatatcctaattgggcattttctaatattggcataatttcgataaggacatagcagataacattatttattatgcaaaagattgacatggagatacagtcatatattagtctcacataaaacaagcacgtcatccatttcaactaatcctagtgcactagtggagaagaagatcacaaagcaagataataaatacaaaattatttttaaaataccttggtttgccttggaggagtgtttccgagtgtaagcttgcaaaaaacacttgggtttccaacagattgcttcatgttgttaccgcgcttgatgatcaccaccaatgttcctggcaaacactgcaataaaaattctgccttctcctgaaagcgaggtgggccagactggattaagtactgcagcaaaggtatagcatctgcagctgctattgactgagctcttgaaacttctgctggacatgctgaccaagcttgcctaagcaggaaaagtgcattcaaggcagcttcctgagtagcctcagagcctgtctttaaggacgtaaccaaatggggaatgctaagtgttgctggttcagttgctctcagtcttgggaagttgctaaatagagaatttaaggctttaagatactcatcattcacagatccagtagcccataagtccttttcaatagcagctaaaagaacagacacaaaaaatgttaggcatatttacatactgatgagagaggttatcaaggtgaagcaacttattgtcagacagacagaatcaacattgctcaccaatgaattcagattagaaatagcacctttatctacagacaagactttcaaattcaacctatactttctctgatacattaatgaatatttacagaagactaggcgcctattttagctagaagaggttatatagaacaactaagagtcaagctgttcaacttatgaagcaattaagtgcactacaagttttactattcatttgttccttccccaaatttttggtttcattaccaataatcaaccaaaaagaatcagctctgctatttttccaaaagatgtattaaaagtcacatgtagcatttttgttttttttttttattgaaaatcaagttatgcttctgcttataatagcaaagaaaaatgctttactatgtctatgactatgagaatcaattatttgattcaagaacaagaaaacaacatcagaaattatcatgtgaaaagtaacaaatacaccattctatatgatgaaaagcgaagataagatataccgtagtggttcagagtaaaaataacaagtatttaacactgcacgataggaaaataactcaccagttattgctctgactgtttcactagaagcatactcttgaatggtatgatttgaaaatagaagtttaataaacattgcagcctgaacagatgtttcaggatcacttgaacctatcagatccagtataacctgaaccccacccgcctctgcaactgctcttttatttgatcgactgtacatcacaaggttttgcagagcacatatggctacaactttcatttcttcagttggttggtcttcaagcacattcactaaagcacgacaagctgaaactgcatcacttgtccgagcaagaccctcattctgaaatagatcaccaagagccaaagttgctaatagccttgcttgttgtgcttgggtttgtgggtccaagagataatgggataatggtaagatggctgacttggtaacttttgtttctctgatctttacattgttaagcaaaacttctaagagtcttgcagcagtttcctcgcactgatgagatcttaggagctccaatagagcctctatagcaccactttcagccattgcttcagcgctagttccgtcatcactttccaacacaagaagagcatttaatgcaccaacaactgtgctttctaagccagaccgaagcagcctaaccaaaacagcaactggaacttccaagtagtattcagaactaaattgtagaatactagccaaaacagaggcagcagactcccataaagcatgaggaatggaaggatcagattgcaatataacttttgaaatttcaataacaccaccttcttttgcaatttcatttggccatatcaatgcaatactgaccagggcctttacagctctttgctgcaatatatgtataccagaaccaagaactcgtataagagggccaattacctgttgcgtcaccggatctttctgaaggtgttcttctaaaagtagatgcgagagaagctcagcagccaactgttgcactgctgatattggagaatcaagcaaagggataagaggttcaataacttggtgacaagtcaatgtgtaatcagcacgacactgcggatgttctaagatattaactaaaacctgcaatgcactatgttgtccatctggcccaaattcttctcttgtcagcaacataaacaggggttcaactactttagcagccgatggtcctttagctatgctagcattattggtcaatatacgcaacaattctgcaaaagctgcacatagataatcaggtgcttcatgaaggatgtcaagtatgctttcaataactccagctttcaccatttccattttacaagctggcctgtcttttcctaacttgaccagagctctggaaatggcctcatgaagtacatgattcctaccataaagtaggccaacaagaggaataactgcaccatgtgcagcaactaattcagccagttgctcatcatcaacaagcctatccaatgcacggacaactgaatggtgagcaggactaaactcacttacaaggagagagaccagaggttcaacacaatgtgcagcagccattgtagaccgaatccttgtatttccaaaaagaacagaacataattcagcagcatcccctttgaggtccattgagcaatctgatgagagaatcctgcaaagaacatccactgcattcatctcaacatctgcaacagcaagtgcttttgaagggttttcactcagtaacctaaccaatgcagcaattgcagcatgctgctctctctctaaaccagtattaagaatctccaccaagggttgaacagcttgtcgagcagtctctgcatttctaatatggtcagcagagaataaactttccaaagcttttgcagccctataccttgcagctcttcctcctaaacgcaagacagctacaagttgagtaacagctccaaatgctgactcatgtctccgaatttctgcactgctaaacagaattcctaacaaatctgtagcagcttcttccgttgcatcttgcggacctagtgaaagatacttggaaagtgcctctagggcccctgcctcaaccattaaaatcttatttgatggacaatctatagaaagctgagtcaaaagcccaagtgctaaaaatggtgctcctgggcgttctggaattggtttgagcagatcaactagagcaggtattgccttccgagaagtggcaccaactcttatgtcatcaactctaaacaacctctcaagagcaacttgatcaggataatgcaccaaagaaaattcatctgacaattccagaagatcctgtatatcagaatcagcacagccaagcaaggagataagtccacctgctgccccagaatttgccacagacagaagtgttcccctgctaccattacagactaggctagctattgattgtgcagcaaaatatctgttcgctgattcctctgacttcaataagttggcaagggctggtatagatttcatggttgcatgcgctcgtatgatatccctatcttgaaataatactgccaacaacaaagcacaaatccacatactgctatcttctttataatcaatctgcatatcatatcaccataaaggagcaaagatttacacacagaaataatagttatatactaatctgctatctaactactatgtcaatgaggaggggtgtatttgtaaacaactttgaaagatatggatgcgtctatgcaaataagtaaatatttactatggaaagaatcagataccactgtctatttcaaattgactgaaaacatgcactagaatacctgactatattgtgagaaacaatctgcaatcctgtcagtgagaacctcaattgctccagcctccattattgcaattttacttttttcatcatggcaagcaagaacagacagtaaccatatagctaagttggcactggaaataagagcggtgccagtgcttgatttacaatcattggcttcttttgtatgcctgcaaatgctgataacttccctgctgtcatcaccctgattatccaatgtagcctgtgaaaaaataagcatatcgaccagagactgaacaagattagcacacaagtttgataaattgaggtcctccaccagcttctgatgatttactttagcagcacaaataagaacagcagctcctccaattttgacctttacatttttagaagtggaattgattatccttttagctatagaagatatacatccagaggcagtaacaacagtgtctcccagaacaaaaggctgatccttacataatcgagataatatttcaatagctttatcctgcaacactggcgttgaatcagcaatagacaaaactattgggattatgcttttaggaaattcagctaaaactgcccaagcaggtttactgtgtgcactggtcaaatctgacctggaaagcatggcaagtgcttcaagagcttctgatgtggaactatgttcatcaatagcaaagtctaagaaagaaactaatgcaagaacagtgccagctcgattcacacaatcagttacagaataatcaacttgcctcttagaatgtaagaggcgagcaattgctgcagcagcatgtgtttttccagaaattgtgccttcacgtaatactctggtagcagccaagatgacttcttctgcaacagctttctcagcaatttcactatccaaaataagatttgccacagcacatgttgccagctctgccacttctaaaactgaagagttagctagtgcagctagggagggtaatgcatctctagcaatagcagccatatccttgttctctttgatggaaagaaatatagcagccaagcagcgcgaggactccattaagatactttcagattcaacattaagcaacttcattgctgaccaaagagttttaacagcaatgctgctttcacgcacatctttcctcgtttcaaaaattcccgccagagcagatgcagactttgcctgagtttcttccttggttgagctcaatagttttatcattgtaacaattgcatcactagcagcactaccttcacgtagaagatcagtaagagcaacaactgaaagcatacttctcaaagcatctaaaacataaaccttagattcaggtaaatcactagtcaataatgctgtaagctgactgatagttgctgtatcagatttatgaattaagtgattcaaagtctttgctgcaatctccttcccatttgggcttccattcttcaacagccacagcaatgcaggaacgacttcagcactttcaacacaagcacgtatatcctcactgtgatcgcataggttcctaaggattgttgctgagtcttcctttgcttttgcagatcctgactccaaaatttgaacaagaggaggtataccaccagcagcagtaatggcccatttactttcatcattttcattagataaaaggcaaaggagggcaacagcacattcttgctgctgttctgatgaaagccccagaagagatatcaacagctgaactccttcacggccttgaagtgcacgccatagactgcattcagtattgcacaatgtcaagagagactttagaagctcctcttgcacttcattggcagccatcgttattaaaccaacaagcaaacgctttgcatcagagtttgtaagtttaattgacaatataggattgctatacaaactagctagggcttcaatggtccgttcctgcacaaggaatggcaagtgaggtttaaattgttcaagtaatgtctgctcaactaccaaaggatctgatgcccaggtagattctgccttgtcatcatatatcataagagctgaagctaaagcccccaatgtgtcagcagcttgagtaggagaggagcatgattcaaggctttgaccaagactggagatgacatacgacaacccaccagagatgtttgctaaagcacacatagcattttcctgtaacgcttgagcatactcaccctgcatgaactctttggaaggagctatggtagcattaatcaaagcaggaatgccattggaattggctatctctttccttgcatctttgcactgggcagatagagatttaagagcaccagctgcctcagccctgacaggggcatcattaccagggcctaaaagtttgaggagttgttttgttgtctctgctgtcaacaactttgaacaaacagatgcatcctccatcatcatacaagcaagtaaaaagcacacattggctaaagtgctagactgcccagttgtcagtaacttaattaatatgtccactcctccagcttgtattgtggcattccagaatctctcagtgctgctggagagatttttcaatgccccagtcaataaattatcaactacatttccagtcttcaggcccttttgcagctgctcccatagcactggaacaactccttcagttgaaaaaatttttgatccaacatgatctttggcaccaccttgagagacagcaaaaatagtctttgcagcagctacttgaccttcagcagaactggactttagtagaccaagcaaaggaggaatgcaacctccaagcaagactttcaccctcagctcattttctttacaaagtgagcccaagacagttgctgcctgtattttcacattcaatgaccctgaccggagaagggaaacaagtactggaactgcctgagaatgagatccaacagcactgaaagcattttctctcatatctataagctccaataactgcttcaaagaatactctttctcttgcatagaagatgagctctgacgcagctgctcaatgcattgggcaacacttgctaatgtcccatctggatcctccatgctgctgctgttgctacgttctctgcaaacaattaggaacgtaagatacaaaagtttgcacattagattttatgctcaaactcaaatttccatagaccatatatcaattatcaaaccatcaagttagatagttctcattatcttctatgtatgagactatctgagggggtgagaggggaacattttttttctgccttagaacttttgacatggataacacaataagagggattcagaagtcttagcttagctgcaaacagaagtactaatgtaacagcatggattttagctgagcattataagcaattgatttggtgattttttaagccataaaatattctttttggacataattaaaaggcatatcctaagctgtaaccaacctcaatcccatcttcagaactgaatgaggaggtagaggctctgaatcttgagccttcccatcaccatttctttcctgcaatcaaaagaatcacagtgagcaagtttaaacggaatgtctgtacatctgtaaatgatgaaagtaacaaaagttaacataaacatagaaacaatatattagattcggtacaatatggataaagatcaaccttgaagttctataagaggagaaatggaaaatgaagttgaaaaggaaaatagccaaaccatatatcaaaccttgacttcattttgtatcaagtaattgaagattttcaaagtattaaacacacatgattgttgcttccgttacagttgactaattatcattaaggatagcatcttattgcacaaaacagaggggagatataaaatgaaataaaaactatacagcattaagtaatgcaacaaagcatttgtacattacactagtgtagaacaattaccataactaacccattaagatagatggtcatgaatgctatatttttaagagaatctaataatgccaccttttatttttcattttctagcattaccctgtactcaatcctagtgccaaggatatgtataagcatataccaaatgatggtagagtgcatgactaaaataatgcttgctacctaaaatagaatatttctcatcaacttcataatatttataaaaccatgagcatctcaattcaaagaatggcaacagatatgttccaatgggatataagaaacagataacgaaatgaaatcacagagcctctttagatttccatggttctcatcggtactttctagaattatttgatacaaaaaaaaaaaaaaagtgtttaatacaaatcaagggttgttgggctagttttagaagtctccacaaccacaactgccgttgcatctcccttccactgtctgcaatttctaaaatcacagcataacctcgaccgaaatttaaaaacataaatgaccagcaagcaatctgaagcgataatatatccaatgtgtacaggccgagttaaggattcataacagtcaaaactaattgtttatactaattctcaaacacttttcctccaccagtaatgatgatgtgatgacataaaatgaataaataaaaaaggagaaataatggaaaaacatgaagaagtaccatatcattagcagcaagggtgctgccattattggcagcaaacctccaagtcagtgtagtcgccagcttcgctccgcgtcactcgaattctcctccaagcagatcaatccaggacactgctccctctccagatctacactggagagttcgtcagcacatcaaagcctccctgtccacaccacacggtaattcagatcagaaaccaaacagcaattgcacagaaatcgcaaatgcaagttcaacaagttaaaaactacacagtgacctaaccaaaacactgtaaaaaaaaaaatcaagctaacaatggaatcggttaaaattgaatcgcgcgagagacagtcagagagattggaggtagcagatcaacagctactaccgaggaatgggagtggaaagcgtgcagcggggtcaacgaaaaagtcaaagcggttacgacggaatgcaggaatcgaatgaatgctagtgaaaattgaagaattgaaaaaaaaaacgaagaggtgagagagaccttgagggagtgagaagcgaagcaggtttgttggtgtgagaatgacgcatggattggtttagcggtggcggtggtggtagtgggagacagatttgattattgattattagaggtgaggcttcgttaagaaaagagtgcgttatgtgatttttcggttttgaattgacggagaagggagtgtttgtgacaatgagcaccgacaacagctccagcctgcaagctcatagcctcgccgcgtcatttaacggctaggctcagccttcaggttcgcttgagccacccgtttggaatagaatcacgtggaaataaaataatgtacctctttttacatttttatatcatttctcgcatggacaaatttgtatctcatcatttttcttttttaaatttttttctcatcagtacacttatcatttttattattattttctcttctaattccaccccaatctatttcatttcagagtagataataatcaatacttataatcttttgtatgcatatttttattagttttaatacgtgtgcagacatgtacaaaattgattaataagtattataaatattatattaatatcgctgattaatatttactaacataaatattataagtattataggtatgcgttatattcatattcatatttgtattttattatatatatatatatatatatatatatatatatatgtatacatattatagtaaacccacctcatactaatgataggacacaaatcattttttgtgttttatgtatttttttaatattaattaatttctattaaactttaatgtaaaaattaaaaaaaaatgacttttttacaatttttaagatttttgataccatgtgaaaatcactattaatttacatgtttcataaattgtaagtttgttgaaaatcactctcttaaaattttcagtgattgaattttctctttgaagattttttttcttctcttaaattataaattagatggttgaggttattaattttggaatacacgtaattgtcctttggaattaccgaatgtcatttttgtattcatgtttttcaatctcaaatacaaataaatagttgcttatatttttagtattttaaattttaaatttgcgtaaagaaaaatagattctttgaaatgatggttctttgaaagtatatatattttttatatggcttgcataacattgcgaattttaacttgtgaagaaattaatgtatacaataaataatgtttgcctaagaatattttttattaaatacgttaaccaactacttcaattaaagttttaatgttccaactaagttcgtatatattaacgatacgaagaactcgagaattttattgaccatttttttttttgctgagattattgaccatatgtttatgaaataaaaaatgataccagtgcaaacattattttcaccaatttcttacagaaaaacgtggtatatatatactggccattggaaaatagatgactaactgtttatacagagtttgttagtattaagttttgtcaaaataaagttaatgcaaatattatttctttatttacagtagtttttgacatatacaatattattatatatttttttaggaaagaatattattatacttaagtactaactattattttctggcaaatatattaactagtgttatttatttgtgagtacactcgattttaatagaaacattaattattaattaccttttctttgtacagagttaattaacatttgatatatacttatatgagattttaatttgaatttaatatattttatattcagatattttattttaatttaaaaattgagattagacattcacatttacaaaagataatcattttcataatagtttttttaatatatatatatatatatatatatatatatatatattattaagaaaatttaaatcttatgcatcaattacatatcagccctgctcttcccactaataaaaagcatatatgcattcgttattggaagtaattaaagatttttgtgatttattttttccaaatttgagaattttagatttcttttaataattttttttaggttaaattaatttttccctttatttatttagttagatcaattcaatccttttaattttttaaattggtgtaatattgtcgtttttatccgatttagttaaaatcaatagctttgtaatttagtcccttagttttgaaagcattgtaatttacatgacaacaataatttagtaaataaattatttatccaactcgaataaaattatcttaaataatatatattagaaaaaaatgttgatttactattataatatttttcacttgtatttacatttttttttactagtaaactgtttacttaaaagtgattttatcaccatttacagataataatattttttactgaaaaaactttactttaatctcatttttaattaaagacaaatttataaaattaaaatgatttgaaatcatatatacaaaatattgatctgatccaaactcaattgattttttcataaaaaaacacattatatattgttttgacccaataattaacaagaaccaaactccaataattcgacttaaaaaaaaaacttcaattattcgttgcatatgaccacatggttttcattttagctgagcttgagctcttgattgtggccaagccatagcctacatccaaaaaaatggaaagtcatctcaattatatcccatttttttgtgcttagttggcaaaggtatattttctctctcactctattgcacagtggagcgtttgatggcaatggaatcctttgatttttcaaaggtagtaataaaggcatataagaaaatagtcttttattataagctgtgagaggtgggtgcagaagttaaagacaagctaccaagcattcatgttattactagcatatattatatgcaccagctggcaagtcatgaggctagattattatgcaataaaatcaatgtgggtcatgttattcgcacttgcaccctgtaagcatttgctgttatcatgcaatcatagggaccctgtacagtaccagctagctaaaccacccattacttgttttattattctagtcttaaattaaactaacagcaattaggttgcatattaatgttaatttccttcgatcgatttgtctaatcccctatactgtcttgccccttgttcatttgcacacatccttattttttttttttttcttaagcagatccagatgaccaagtggcttttgttatttcatcccatttctcaaaatactgattcaaagtcgagtttggctctcctcgttttttaggctctgtttgtttgcgaccacattggtaatttggtgcatatgaaattgagttgggcttgtttggtataactaatgcatgtgagaaataatttacgaccaacctaagcggtcaataattatcattataacactaaattattgataaacattgtattgggctttcatttaagagtgaatatgtgatgaattgggtcattcattgtgtagctcgttgaaaaaatccttacttgctactagtgagttaaaagactaacatcatttttattttcagtttcatacccatgtaaaagctctctagaaaatgggcaatttactctcaatacaataattgagttctctcatgagttgaagagccatgaacctaataataaatctaggtattcaggtacacgtttattatcccctctttgtcgtaattaatatattgtaatttgtacccttgtgtgatttggacattctacacacttgctttaaaattcatcaattggtatcaaaacaacttagatacaaattatggctattgtttttcattgttctttcatcaaaacattgtcaaaacgtgggtttttttggcttattggttatttttctaagattattaaaaaacttgttaatttttcatacattaaatctataattgtttgagggtttttggtttatttgcttattggtttgtgttccttatcatgctcgcgacaacatattaaaagtgtgatttagtaaactaattataaagaatttgatggttggttttgcaaatatccttccacgaaccctaaacatttcaaaccaaattactcacagatatagtttttttcaaaaattgattgagagatcgtgtagaaaaagtaaatttcaagcaaaactcatcctcaatatcctttttgtattggtttataaacatgagagaattgggaaaacgcttttgttttttgatccattctcacatctgcgattttgcttctttttctttctttcttccatgtatgtgtttccaacctttcttctgaaattgattggggattctctatattgatagttttcaaacaaaatttctcaagttttactatgtatagggacattttatcaaatccataacccataaaattttattttgttgtcatttttgtgaaaaatatgtactaaatagtttatctgattacatgtcttagtgagtgtctgatttcgattaaaaaacatatgtatttgatatttttcacaacaatttcagactaaagacacaaaagcctaatatacttagtttagtgtgatgcgcatcaccttaggtgctcatacatccaaacacttacacacttgttttagtaaataatgttatattctatctcaaataaatccaatgtttagaataaatccttgattgacttattattattaatatgctcatttataaattattgtcaaagataattttgttgaacaaattttttaaatatttacaaaatatacgtttcttgcgttgtatatgaatcatattgatttatagttggagtttttagttgatatcacattacatacttttagtgtgtgattggatagctccaaaatcatggttgatcatgatgaggtaagtcaatcttaatttttatcaaatttacatgtttagattatttttaaaattatggtagaatcaattatgatggaaaaaaaaatcatggtagaattgaaacaaataggagtaatttcaacttctatcaaaatcagttatgtaaaatcatcatcaatctaaacacacacttatcatgttatcaaagctaactgatacaaaaaaattataaggtgattttaaattctatggcccgcactaatttttataggattttgctaactaatatccttaaaacattagttaaaaaactaaaagaaaaaaaatacttatgatggagattataagaaagcataaaaaagtcataaatgataattttgtacatctcaataatttttaattctttaatcttttaaataatattctaagaacactagttaacatttgatatttttatagatatattaagtgttattaatattttacatgtggtatgcttaggcctagtaagcccttcaagatattatgcatattaaggactttcttttcaaaagaaaagtaataattatatctataaaaatatcaaatgttaactccgaaaatatcaaatgcttaggcctagtaagcccttcaagatattattcaatccgatgtttgtcctctctgtatggtaactaggggtgggaataggccagaccgacctacatggacctacgacctgccctacataaagtctggtctgaactgacccatttaattaagaggttaggttcaagcttttttaaaaagcttattaaattaaatagatcagacttaggcttgttaaaaagccttataagtctgataggtcggcctatatatatatatatatatatgtatatgtatatatatatatatatgtatatatatttatattatttgttgataccaatttatacttatattattttttgggtacaattaatttttttttgaaaccagcagactttgattatacattactgctccataacttccattcctataatcaagtaagactttaattaccatttaggtgtgaattatgtacccctttatattacccatgatttttattggcttttttgttaacgtttccttttccattaactttcctattacgttcctacgtcaaagcaaacaaatataaaaaggctatcaggccaggctaggtttttaaaaaggtcaggccgagccaaaataaaagcttttgataggctataggccagattcaggcctcaaaaattaatcgtaggctaggctcaggttttttaaagtttggtctagcctggcctattcccacccctaatggcaactcattgagagcgtaattgggccaagccacgcggattgttattgtgagtggcaatttgggggcaattgcttcctacacctctaaattacttaatgcaatcccataattttaaatatatccaaattgaccttattataacttcatttctaccttctttctcatttctccttcgttgacgcattattgaggtgtgcagaaggagtggttcgtatacattttaggcaaagggagtgtgaagtgggtattttaactatttttttccaatttgcatatattttccaaatagctgaattcctaagatacaaaaagaaaaaaaaccacttccaaaaaaacatttccaaaatcatgttaacattattcctaaattgaatttttggaatgcattttttctggaaaaggtaaccatgaattatgttagcataatttcataaatgcttttttggaagtgttttttttttgtttttttgtatctaacaagctcaactatctgaaaggtattagagatttttttggattacatattttggagaatgcttaaaatcaacaaccataccagtcaattcaccaacaacatgccattgctatcttcgtcaggtgcaaaaagaaaataaagaagaaaggggttgaggaaggtctcggctcccaaaggaaaaggaatgaggtataagagacactcaagggcattttgaaccattcaaattgttttaaaattcctatgggatgcaggaagcaaattaaggggtctaggaagtaattgtccaatttggttttccaacaaaatcatgcttatggtgaatccactcaataaatagatgcactagctaaattttgtttgtctcaatgtgttccttttcatctctttcattttgtttctcatttttcatccttaccatatgtttgctaaagtgtctctttttctagaaacttttagtttgggctaaggccctgtcatgaataaaaatagaatgctcttggggtgttgctagtggtcccaacctctctatggaaaagtatattttgcccctccttcttcctacttccttttctcctaccatctcatccactccccccccacctattatcacctaatcccgaccagatctagaatccctatcccatttcctccatgccgcacaccactaccagccttaccatcactattgcacaaaagtccctactcgtgtatgatctccacttttgaggctccatgggcgcaactcctccccatcataactatgccgccatgaacattcacagttgtgcactcctttgtcataatggaatcacatttttgcatggatatttggctgcataaaatcgtgatttcgttggattaagtgggggtgttgcaaaatataacaatgaaatcatgatttgttgttatatttagcgtggaaatttttttacgataaaattgtgattctattgtgttaggggggttgaaaactaataaagaaaagaatcacaatttcattatacattttattcaataaaatcacaatttcatataaaggatattcttggaataaaaaaacttcagccccttgataggagtcaagaagcaattttaatagggcaatagtaacttccctcctgtgttgggtattagaacttttatatgtcggcccaaataagaaacagaagcccagctcaggcacggggagatgaaattctcgattatctttcagccacgtgttaggggcattatcggaatcacaacgagaaaatcttaatgttagcaaccgctgtggaaccgagacccacttggtattacttcagggttccctcacggaacggaacaaaaggcgcacacaatcgccaaagagaaaaagaaccctcaaccaaacaacaacaacaacaaaaaaaaagccctagaaaagattttggagaagcaatttctcactcctgaaaatctcatcctcttcttctttacatttgttttggataaaacattttgctgatactgaattttattttctcttgttttcgtttcttttcgacctttttttttttctgcttcgttgttttcagggagaaagggataggagtaataaaagagagtgcattcggtttggttcttcgcctcgggactcgaatcttcgatgcctctctgttttttcttctctggcgcctctttttctattctcaaattagggtttccgtgagcgttcctttttctcgattctccgcaaactattatcattgtgagtaattctccgttctctttctttcgcttagtaattcatatatgaatgtatttttatatataagttattttttgtttgaaatttcatggtttccttagatcttgccgttatcaatttgatgtccagttctctttctgcaccaaattctttcagtgtggtttaaattttaataaatagtttgtatgtgttagtatttttttttcatccgcacccagttcagtgtacagtgattttaggatgaacactgtgattgttggaattgattgttgtttgtttcttggtttttgtgaatttgattgttggcttcaggttagggaaggtgatttgcgtttggacataatgtcgtcaaaatatcagattcttgacaaccgccctattaatcagtggaaggttacagagctaaaagatgagctgaagaggaggaagttaagtatcaagggtttgaaggatgatttggtcaagcgtttggatgaagtccttcgtcttgaaagggaggctgacgaggcttctgagaaggatgaggccaatggtttcgatggtcatgtagatggggaaaaagattcagaggcggttactgtggatgctgaaatggttgattcaactgacagggacaatgccaaaacatttgagactgctgaaaagggcaagagcggtgtagttgatcctgttgaaatagaaaatgtggaaaagattccggaggttgtggatcacgacagcaataagaatgacaagcaggatggtgttaccaaccaagttgacattaataatagtgtgtcagccatagatcaagaggttgaacctaagggcttgccagctggtggagattctgcaaatgtgggacaggaggcaattgcccatggttctactgtggagaagactaccattacagttaatgagagtgtagtaacagaagtagtggccagtgctgaggattcttatcgtgcagaaaagaataatgaggattcagcagcaaagctggagaatgaggagtcaaaggcgcagctggatggtgaggactcaaagccccagctggattgtgacatcaagcccttgcatgaggatcctgtgcccgactcttctgttccagaaaaccaggtatctgaggtcaaccctagtttagggtctcaagtaaaatctgattctatttctactgattctctgtcaattaatcaaaagaatgaactaaaggatactataattactgataatgtcaaattagaacaagatattgttaagccagagatggtggaagaaccatcatccagaaatgatgtacctgtttcttatgatgaatcacattcaatggatgttggagggctgcatgagaaaaaggcatctgttgaagaaaatttcaataatgttttaagtccagacatgaacaagaccaatagcagcgatgatgtggggtatcccgaagagttgaacttggacagaagttctggtgatgattctatggaagaggatttgcctgagactaagcaaattgattctaagtttaatgttgatgaacttaaagacaaaatagagattgaagagcctattgtgaaggaggaaagtagtactatagctgttggagatggtctgtctgcaggagaaagtgatatccaccaagatattgacattagtccagttgctccaacagagaaacgaaaatttaatggtaagcaatatattgtctgaaattgacacttttttttttattggttgtactcctgaagggcaagaaagaattataggcactatatgttgctttactggcatgctgttattatttcttctttgtattttttaccatccagtattgtttggaacattttgtcacagaacaagcatcagttgggaacaatgagcctgcaaaaaggcaacgcaggtggaacactgaaacagttaaaggtccagatgcacaaagcactactcccaggcctgctactacacctagagatgagccaattgctttgaaacgcaacttctctaggtctgattcctctgcaactgatgatacacctaaagaacgcattggtaagtcaacattgttgtgattagggtaaatctattaagaactaatgctcctgtttgttgtgtaatggtggtgttaatggagatcaaatttcaattcctagctttgtggctcaaataaataaattcctggcaccttcagattttaatcctggacacttcttgaagcacaagttgcatatatcttatcctctaaaatgtatttgtggaggtttttattttaagatggacaactacctgctggttgattttttcatgcacttgtgcatttactgagataagacttagttgttgacttgttggttgtcatgcgcttttttacatgggtgtattttgtctatgttgtacagcatgtttttttatggattactttgttgtcatagtggcatgtgttgtattgtctgtctctgtttttcaagttaaatagtctttttttaatctttggcagttccaccaccacaaaggtccccaactaattccctcaggattgatcgttttctccgtccatttaccctaaaagcagtgcaagaacttcttggtaagactgggaatgtcagcagcttctggatggaccaaataaagacccattgctatgtgactgtaagataactcttattgctgtcttccttcaactgtaaattttcatgtgatgttgttatattatgacacggttctgacatctaagtaatcttttgttgatttcttggtgaatcagtactcgtctgtggatgaagccattgagacacggaatgctgtatataatttgcaatggccaccaaatggtgggcgtctcttagttgctgagtatgttgatcctgaagaagtgaaaatgaagttagaacctcctcctactcaggctgcatctgtcagcactgtcccagcagttcctcctgcacctccctcacagccagagccttcccctcgtctgcacagggagccgcatccagttccagctactctcccacctccaccaccattgtcaaaacccccaccagtagcaagagaacggcttccatctccaccaccccttcctgagaaagttgacccacccattgtcactctggatgatctctttcgcaaaaccacagccactcctcggatctactatctacctttgtctgaagagcaagttgcctcaaaacttacagcacagggtaaaagcgcgaggcagtagataggccattagcctgcaaatcttcttcccttgcagcctttactgatttggatattttaattagtggtatgggattattttgaatgtcttggcagatctggtggtgttttgtctcgggaagaaattgcattgcttgagacttaaatttatttagttttagaagtcgtgaactaagagctaccggggttggatagattttccccactgtttgaactaggcttgagcgaacctttacctaaaattttatggaaaaatttgacgttagaatatgtttatattcctagccacgaattttgttttcggtagctggctttttcttgatccgtgtattttcttatgctgagtgtcgattgattttagtctgttgattgagcatagtagatttcttctagccacgtggtttgtttgacatcaagtctagcaccgtaggaaggttgatttgtatgggttgactcgccaatttatccaccgtttgggagaatgtatcgcaagtttgttgttattttgggtacagtatggcatggatgtttattgtgatttggttttgatatgacttatataagtttttcatccataaaaaatatggtgttttcaaattactacttaatcacgtcactgaaatgtgactaatggtataacttgaaacaaaaaattttgaggtaattatttgataaaaaatttttttttagataataatttaaaaataatttatttttgaggtatgaaaaatttatttaaaccttttgattttggttgttattgtgaaaatctaactaaattgcatattaaatttatattaattttcttttacattcttatttaaattatcttttctataacttaagctggaactcattttttataatgatagtatgtggttttttttgtattgaaatcttagttatattgcattatttatatataatattgatactgcataattagttaactaatgatttgtaatgtatttttttatgaagtttataataatttaattgttgtcaaaaaccacttaagctgaatgaaaactaaacggtgaaaactaaaaaaaaaaagaacaacacggtgaacatccctactactaaggacgttgtatttgtttgttgagagttgtgggcctgtggctccctaggtaaatcagtaaagaaagactaactattcatttccctccttaaaagtgttaaaagtccttcaaagatagaaaattaatttttagtctctcaatgtttaaaaagtgtaataaaatcattctataactttttctgttaactatcacgattttacctaacacttttcgattaaattgtgataaagaatgtacatatgtgttgtttggttagcaaaatgagtaagagacttatttgtcagccaaaagtggatggattattttgtctctctcggagatttcttctattttttctccccccatttctttatcgttacaatcccagcttcccttccaatttgttttcacgcagttcatctttttcacctggatgctagcaaatagatctggttgacccgtgaactgaaccgcacgctgcaaccatttttggcgaccaaatggagtgggaagggatgcattttaatcatcttgtgaaggggggaaaacccataaccaattttgcaaaaggtttgataaaaaaaggaaaaaaaaaaacacaaagaacaaacatcatttgcacaacaatacgctggatcacttttttttggcaaattctttcatttttgaacaaataatcaagttctaatatatgacttgctaagaattggtttatctacaaaagcccttgattgatttaaaaaaatcattgagcaatgagcgagaaatttgaagaaaatgaaagaggaacacgtttggtttgagcaacaatttcataaatgagtgttttttgcaattactcaagtttaagtatgggttttgcttgaaattgattgaactacaagaacactcaatcaattttacaaaaaagaattcaatggagcaaaatcaagcgcaaaaagggaaaaaaaaatcccttttaaccttatatgttaggagtatgcttttgggatccaatttttaacctgtttcaaccttaattgcaataagcccattggtgagagaagaagatatagggaagaggagaaaagagatgatgggagggaagttgggatagcaacagtaaaaaaatgggaaaagaaaaaaatacaagaaatcttcaagggtaacaaaatagttcaacttttgggtgataaaaagttcatcctactcattcccccgactaagcaacacacatgtacattcctatttggtcaaaagatgtcgtgtatacaaaattgtgagagttaaaagtaaaatcattttgtcacactttttcaatattaagggactaaaaaataatttttcatctttcaataattgaaatgtcagaatttgacactttcaaagactgaaatgagtatttatgataaaaaaaaactaatgtcacccatttagaatacaaatttgagcatgaacatgaatattcttaataaaatattgttgcaaagtgtgtagattgaatttgagaacatcacaggtttacaccacaagaaaggatcagggaatttttaggaaaaaattcttgagtaaccaaaaaatgaaaaaccaataggtgtagggatagtttgggttccaacaatagagtgtcaaaacctgatagttgctcaagtcaatgaatctttaaagcatctccaataacttttcttacaatctaatctttcatgcaagatctgatcttgttaagatttattactagagtaaaaggattgatttccaccgtggagatctgttcttctacaagaataagcaagatctgcatgtgttttcaaaaaatgatattataatgtctctcttcataaaaagtgtaaataaatattagaaggtgaattcattgtaggacctacaaaaagtggtttaaaatcacaaagcttgattttctattgaagcaaaaaattggaaagatctctagaatgatatagtattgcaaggtgcaccaaaaagttgacttagatcacaaagtttgatcttctattaaaaatgtctttagcgtgtgtttggattataatttacaaagttaagtttaaggtaacataactttttaacttaagtttatagataaaagtaagttgaaagtaacttgttttatgtttggatactttgttgtaaaagtacttttgacagaatgaaacttatttggattatttggatgaaaagtacatttgatattgttgcaaaggaacaaatggatgttgaggggttataataaaggtcagatatggcttctttaaattttggcaggtaaggaataatgaaaataattatgggtttaatgctggttgtttagaggtaattgctggaaggagttattgaaatttttaaaaaaaaccttatctttctaacggatccaacgaacgttaacggaaaagtaacctatagttgcttcccattaaaagtcggatcatgtgcaattcaagtttagttgaaccctcgtttgtaatggtctcacagtaagttcagtgcaacttctactcccgtttagagactcaaacgaaaaaacaaacacaactttattttttttttcattacgtgcgtttgtacaactactatgaaacaaacatgaaaaatgcacaatttactcgtagaaataataataataataaaaataaataaataaataaaataaagtattttttgaaaaataaaagattgttagtactagttactacggagtatcgtattcgtatcatccaccctgcggcgttgaaacaattttcatggttttgcgccaaataaaataggcgaagaaccctaacttaaaaaacctcttctcttcaagtaacgcgtctttctttcttcttcaactaatttgcattaaaagtatcctcaagtaactaagaaagcaatcaagaaagaaagcttcttgtattcattcattcattcattatgtgtgtgtgtgcgagtacaaaatttatttctggaatctgaggtgtttcatatagccatgttgcttacttgctttagtatgttaattcggttaacaattttttgggtaagtagcatagctttgttttactattcttttagcatattagttcttcgggtcaatggaagacccattacacccttcaacagaaaattgacacaccgagatggtggaacagcaagtaaatgtaaacttatgttataagaataagccactgaagctagataatcagccaccacattagcttctctgaaagcacgaatttattaattgttaacagaatacaatgacattatttgatccatgtagctggtcttacctagtggaaaaggcttctgtttgtttttgttgagtgtattagtcattaatgcaacgtaagttgttgtctttaacgtttgatatagctttatcacattggtgtatatttcaccggagcaaagaagaactggttgttgccacttggaaaaaacaatttgacaaatcagagatgattcaaagggtcctccttctgtatcttgcaaatgacattctgcagaactgtaagcgtaaagggaatgaatttgtgacagagttttggaaggttcttcctgcagcacttaaagatgttatcaagaaaggtgatgatcatggaaagcgtgtggtatctacattggtaagccctttttacactatgtgatgcaagtatttcaactgaatacttaaatgggaaagggtgtaaaagaattgaatataaaatcatagcagatagttcttcatgcatggctgaaactctagatatggtgtataaatgctgatcatatgatttgtttaccatgatattgatctgttaacttagttctttactaactttagattgaaatatgggagcaaaggagagtgtttggatcccaggctaggaaccttaaagatttgatgcttggagaagatgcacctccaccattggaatttggcaaaaagcgatcacgttctgtaagaattgcgaaaagggattctcactccatcaaatcggtgagactgagttactgagggcctttgcaactacatccttcctctccccatttcatacttaaatcattgatgttagatagttacatccttcatagaggtttgctatggttctttcatatctcacttccttgatattgtcttgatgccagaaactgtccataggaggtacagcagaaaaaatagtgtctgcatttcatttggtgctcagtgagcaatccgctgaagatgcagagatgagtaagtgcaaatcttctgttcagcgtgtgaggaagttggaaaaagatgttgataccgcgtgctctgttggtaagcatacagcagaacagagttacagaagtaacaccttaattatggaagttagagttctaatattgtttcttttttcagacaaagatcctaagagaaatactttagcaaaggaactagaggaggaggaaaatgttttgaaacaatgcatagaaaacttaaattagttgaagcaagcagagtagcccttgtatctcagttaaaagaagctttgcatgagcaggtaagttatacacttgtattcaatattttcagtattttattgagttttcggttgttcctaactgtgtctttcaattgtttgtggatttttgtattaggaatctgaactagagaatgttcgtacacagatgcaggtacgtacttttcatgattcttttccacagaaggttgtcatattttgttcatttatcttggtttgttgccatttaattacttctctaatggtacctcttctgcatatatccctaggaagtaattctgaatattctccttgtagtttattttcatgcatatgaagagttaattttcatgaaggtgttcatgtaggtttaattatttctcttatggtacctcttctgcatataaagagttgtgtctggaagatgtttaaataggaggagatgctttgcctgatgaaatttaaatggggaagatcagtgtaatttctgaaacaagatagggtgtttgcgttaagtttcataaaccttgacggaggttagtgtaataatcttgatttatgaagaataaacagttttggttaaagaattgcttagtgaaagcaccgtacacaatttgagagtaaaaaatctcttgttaatattttaatgccgcgtattacttgttgagtctgttttcattattggcatttggacatgtttgcggctttttagctaatcgcaacgacaaatttgaactttattatgcttaaatgtttgtttaaggatatttaggttgcacaggcacaagtagaagaggcttgcaacatgcggaagatacttgacaatgaagattcctctcagaaaacatccactggaaagtccgctgcagtaattgctgccgaggttgcagataagcttgcatgttcctgcgcaaaaagattggtgatcgtaaaaaccattcaaaattaagatcgtgtagtgttggtttgagttgtctaaaatataatgatgtgaaagttttttaaaaaatcgatggaaacattgacttggttcagaattttcttttctatttgagagccaaactaaatacgactaatttaatttgaaataaaaagaatcaattaatcaaattatttgatgaacccctctataaagaataactttctgtgattattactatttaagtcataagatgacgggggggataaaaagtactcgcagtattttataaatgggctgaaactccaacatcaactagactgtcgatacagtttcatactaaactaaatctgtacatatattgtcatcgttatccagtttgagaattgaaggattgcaatttgcaaagaggtcataatccaccctcgaagtttcggaaagaggaagcaagcaataagcagaactgcacaactctgcattgtgcattactgttttggaacagtggcaggaactgtaccagatttgtgcttttaataactgaaggggacatgaggctgtctgtctctgtcacgctccaaattaggattcaagttaagaagtttttgaggatgtaattcaattccattcctatcataagagccgtgtaagtcaaacttatgaggtgggcaaccatacaaacatgaaaaaacacatttataatgttgagaaaaactaacaaatgcagaaaaaaagtatagctggtctatgttcaaagaatgggaaagtttcagacacattctcaagaaactatgtcctcagtttggtcaagttttattcaaaaactttgttcactaaaatatgataaaatggaactaaatagaaaatatctcttctgttgctaaaggtaaagtaaatgctttataaggtgtccatgtggaaagatagatgcaccacctaactatagctcagcctttcattgctttcttcaaaacaaaatctctaacagagatcggtaaatgatacatgatagccatgacagtagagtaatgcccataggtgaaccatgcaggtggtttctccttaaggacagcagctacagtgcttatagcaaactcatctgtaggggttgttttggacttctgcgaaaaataagctctatctcggattgctgcttcaaaaggcttgaataatttccattctggcatgcggttgtagctggctatggcagaatctccaatgtttgatttgatagctccggggacaatattgacaacatcaattccaaaatgtccaagttccagtctgtataccacatgctcgtgttaaagatgagaacaattagataaaatgtaaataattggcacaaaggccagccaccgaatccctaattgttgcatttgcatccactagattttgactttgaagtgcatatatagagttttacaaactccactatattgcagtttccatgaaatcaacacattgatctggaccaaccaaagcctaaaagcttgttcataccaaaccaacaatttctatagaaacaaggtggatttctgtagccaattactgttgcctctagttgatttgatgcagaaatgaagcacaggtgtagagtaacgcaagtttgaagaagaaaaataccttaatgtatctgtcaaagcatgaagagcagctttagaagctgtataagctcctgaccaaggtccagaggccaaggcagcaacactaccaatattgacaatcttcccctttttcttagttgccatatgaggaacaaccgcctgaaccattctcaaggaacctgcatgcgtatgcccgatgaaacatagcatcaagtttaacaagcaattcatggttttgtacaccaaggcaatttttggataaaaattgtgaatgtgattttggaaaatccaatgtacattcttgaatttcaacacacaaaataaagaaataagaatttgtgcatgcttgaatgaaagttaaaaatattgtgtgtgcgtttcaaaaaacagataaaaataaaatagaaacaaaagcaaagatcctgacaaaattacttttttgtctcaaataatttttaacctaaaaatcaaacattatagtttgaggagtaaaagtactttttgagttccaaaacatgtactaattcagtttgcgcataacctttgaggccacaattgacaaataagaatgaaaacaggcaacagcaacttaaatagagtggctggttccaaaatgcattatttatctagctaggagtaactgtagtgaacagaagccatctgcagaatgattaaaatcaatctaaaacaaactcatttggttaatctaatccaacatggcagattaacaacaaatcccatccaacaaatagcatcaaaattccaattaagataaagaatactgaccgaagacattggtgtcgaaagtgttttggatggcagagagaggagcctcggcgagtgggcccacacactgaacaccggcgttgttaacgagcacgtcgatgcgaccgtacttgtcgacaacagcatcaaccaccttacgcacgctctcatcggactgaacatccaactcttccaaaaagaacctttggtcgtgttccagctccgccatgctcgaccgcgacctgctggtggccaccaccctgcacttcttctcagcgaaggcgcgtgcaagcgcgtggcctatccctcccgtggaacatcctgtgatcagaaccacaggtttcggtggctcctcctcatcgtggccgcgcgtgtccatcgtagaatacaaagagaggcagaggaggtgattagattagtgtcaacttgttgctatgccaacaatgacaacccaacccaacccatctagagtacaaaacaaaggcaagacttttatgccagcttttcctatatctagagtagtactcctacaatcaaatgacaagcagctacaaccaattttctctgtcattcatttattacggcttatacatttatcatttatgacaactattaattaataacattatttttcatcgtcaaaaataagaaaaagaaaaactttatttttgagtttatattagatgataatatttatgttttttttagaaaaaaaatgtcttttttatttttatttttggatacacatactatatccattcccttacccacatctaaaactcgggtggaacggtacctcgagtgcacgttggtttgtcatgcttatggacaactaatcttatattctcttttaactgaaatagtagcttaagaaataaaatactactttttttggtaaatagagaaaataagactcagaagacgtcacacttaaaaatcttcttaacaggtttcaatttattcaagtttgtaaaatagattttcaatacttcagaaatgtttgtctcatctcgatccgttaagaccgtaatttgggtagattatgttatttctttactgtaagcacggtaaatattgaaggcaaacttgactacattactactatagaaaaggtacaaagtatgtttgataaccgaggtttcaaaacaaaattaacacaatctcctgaaatgacattaagcctactggctaccggaaagcaatctactcagcagcatcttttttcttcttgggcattctgtatccaccaaccacacaggcatggtccctctcaaatggttcaagggtgacttgctcgaatggtttgaattgatctgccttcaacttgttcacttcgctttcaaacactgcctcggcagggactgtggagtctatgcagttagcctaaacatacaaatgaattcaagtgagaacaatttagcagatagttaagacatagtaatacataagagaagaaactaaaccacttaattcaaggtaatcataaacatttctctttccaatgttttcaatagagggcaagcctcgacacctccatatgtttgttgtttggaggcctgaaagtcccaagttcaaattctaaaaacagccttagagggtaaaagcctgattccttctactctccttagacctcactaggtggggaccatgtgcactgggtcacccttttttaaaatgtttaccatattgattactcaataaagttttataaaaacatgattagatgtctgaacataccttgattgaaataacaaaatgacctcctgctttcagataatatgaagcattcagccccaaaatccttgcctgcaatggtcaccaaaaatcataaacgaaactgatacatagaatataactggtgtttcaaaaatagtggtttgataatgttttaaggagcttttatcttcaaatagaatataattcatttccagaaaatgtaaaaaggaatccacaaatataaaacctatgcaccactccaaccacagccacactttcctcttaaaccagctgcagatataaactatcataacacatcatcacactctctggaccataatccaattgaggctgcttataatatctgacggcccaccccaatacctgtaacaccttgctaatttgcagcccctagaccagccgggggatttaaaaacaaagacagtgtataaacaaaatcctttctctttgccttcatccactccaagaattgaagttaaccatctccactatatcacattctcatacataaaattgaaaaaaaaaaagtacttatagattcaaaatggggccataaacaggctaagaaaagataatccagcactgctgtcaatttaaaaaattaaagcaataaaataatagcaaaaaggaaaagaaaattatgcgcatcagaaactcgggtctgcatcatccatgatgtcttgaaggggaatccgagtaactcatcatatgcacagattattccaatttaacagaatacatgcaagtaaaaaaataatattgaaaattgtaaaatacaaatttgagaaactaaaagaaaaacaacaaaatgaactctaaactgagattttaaaaattctttcattttgaaaatcgaaagttatacacaaatgtaaaagagaaaatgcaacaaaaatatacacgtgtagatggctggctaatatttggcaaccaaacgaaatagtagatgaattgaaattaaacaaacaataatcatatggcactgccgattaagtacatcagtattatggaaaggtagtatgtattgtctgtaaaaacgagactgaaaccaaactcgagatatgttgtaagaaattaaaaccaaacctgatcgggctgagcaacatcagaaaatatgacatcaaccattccgaccagcatcctatacttagctggatgtctagcatcttcaataatgggaataacattagttcgcttctttgccatattaaccaggtcacgtccacttctatgggaaaattctactgcatagacaactccagtcttcatacaagaacaataacacattataatcagcacttctattccacaaatctaagattatgcaattctaaattctaaattttacttacagggccaacaacgtctgatacatgagaaacagtggttccagaagcagctcctaggtaaaggactctggctccaggtttcttcataagacacaagacaaataatttaaaaaaatgaagtgtgatttgaagaacttcgcctaaacatagcacatgttgtaaagacacaatcttacaatccatatgttgtcaactccaccaaggatggcagcagccaacttggatcgaaaaggattccaaactctgtactcatctttggaaccatcttcgttctgcaaaatgaaactatcaattcatgcatccatggttcagtacttaagaagaaaaaacaaataatggtgagaaagaaaagaaacctgaacagtaatccttttctcattgtaaacagcttcaccaggaacaagattcttagtaacaagagcgtcttctttacccttggcaatgaaaataccatcatgtctatggggctgaaccacaaccttgctacctcccttcattccacctctgccaccaccacggccaccacccctgcctccgccacggccaccaccacctctgccacctcctctagctttgaagggagtgcccctgtctcctcctcttcctccaccgccccttcctctgcctctgtcacccctaccaccacccctgaacccaccgccaccaccaaaaccaccacgacctgaacaaattcaaacacttgtcaacaacaaaaaaaaaaaaactattaccacaacattcttacgtcaccaaagaccatatcatctagttcaaatgccaaatgccaaatgcaaaaaccaaaatcatcaaaccacattttcttattaaaaggaaaattacctcttggaggagccattttcgggagctgtaaactgaagtgcaacgcagcagcaacaactggttaagaggattttatagccagccgaacaactgaaatagttagggtttaatagagggtagggttttgattttatagaaaaagaaaaagaaagtgtcttgcatcatccactaacctaaccctagcggtcggcccattttccttaccctgctcacttgttcgtgggcttttatttgggttcatcagtcttcctaacaagcatttattgctttgggccactagcaaggatttctctttcctttctcagctctctacggattaattaagcttttgatattttcaacaaaaaataattaattaaaatcaatgaactcataatatttttttaaaagaactaaggagggtatcaagaatatgatgttcttcttgatatattcagcaacaattttagaatttgctcgagattgatgttcttctttactcaacctcttatttgactccatgatttgttcctcatacaaataaattatttcttcatttgttgtaaccttcaattcaactcctccatttgtgacaacaaatgattcacatccacattacttccacaacccacatattaccccgccaccattactttcaaagtccttgtttaatgatttcttcacatcgtcatcccaaacccaaaatctatagttcttaactttctacaatcacaaacaaacaaaagcaatttaaaaccatagaatagaacacaacacccaataaagagcataaatccttacattccaccaagcacatcaccaaaataacttgtttggatgctagttggtttgtgatattaattaaattgttggcttctcatagagacaatgaacaacaccaccaaatccaattgacgaagacaatgctccaaatgatgccatccacgatgaacacgaacaccatgaaccctacccgaccctcataaaaccactaagagccacccctaactcaaatttgctctctttgacaataaaaacatagattatgctactctactcgtcctagtctcaagtagttcacctaaaaaaccatagataatctaaaacaaaacgataacatttacacaatttactatatgatgcgtatgggcatgtccaccgagacgaaccacatggatctcccacaaaacttttgataagaattcagtgagaaataaaaaaatttcaaggatcggtcacggaattcgtatatattttaaggatctccaacatgtttaagtcttgcatatttattttgattgttataaaaggaaaagggaaaaatatttaaattcttaagaaaataagtgattatttttatttaattttttatatttctttatacagtttgttttaaaagataaaataggaaaactactttcaacttctccttagatataccaatattatactattctcccctctccaatttaaattaccaatcatgtatggagtgagaaaacctcgagcatatgagaaaggggtatatgaatatactactattcgtattattatcaaatattaatatgttccatagaaatttacaaattatttatattctattattattatttagtaatagtagtatagtattagtaatgacattggatcgtaaatgtaaattaaatattatatcattagtatttgtaggaatgtaaaatttaatttaaatgaaaaatattatatgacaaaagttatggtgcaatattgtgcctggtgtgtatcagccatttttttgtgtggcttataacatacttttctaatagattttttttttattgactgaattttattaaaaaaatatattatttctctccaattttatatactttttaaattaatattaactaataataaatcgaacacgtgttaaatagtgttttgtttgctcttctattgttaaaaatttacttttttattggtaaaaaaatactactaaatttactttcattctaattcaaattaattaaaaattatgccctatagcatattatataaaaaatttaaaaaattaaatgtttcaattttttaaaaatagtttcaaatcaagtcttactcaaataaatgtttttcccatcttaaaaagatgcaaaatgcagttttaatttaatgaaaactgaagaatgcatgagagctaaggatgcattattcatacgtatgaaatgacagaaagtcttatctgttttcttggtaatgagaaaagtatgacgaaacgacctttaggagtaatttttttaaaattataaaatttaaataatatctaaaaaaaaataagttatagaatatttaataatttctgagttcataaattatttgataacttttgtttttttttattgaagatataaaaaattatgattttttaatttttttaaaattcaattttaaaattctaaataattttatttaaattaatatttttattttaatttcattttatatttttatatattattttatttaatgtttttatatcattttatttaatataaataatataaaaatattaaataaaaaatagacaaaaatattaaataaaactaaaaataaaaatataggactttgtatattgttttttttcagtgagtatttcttacgagtacttactgaggaaataattagttaaagaaatgggttttgggcattttgggaggcaagcaagcccatcttccaacaagcaaattgtttcccctacagcagcacttggcacaaagtgattgattaatcgctgtggttgtggctgtgaccgtcgaaggcagcgacggagtgaagctccgtacaagggtgttcaagccacagaagaagcagatgggaacttggggattgttctgctgcacccgtattctattttgggtggctgccaggctctcctcaatggttacaccgctttcacctttgacatgagaggcgttgccaagtccaccggcttctcccaagttaaggatgttgttgctgtctgcaactgcctttccaacactttctctcttcccaggattttgttgcttggttcttccgcaggtatgcttcattctcagatctctcacttttcttatactgtttaacatcaccccatccgctttttctacctacaaatcttacacgtatcattaaatttctagagtattcttttaaatttttactgtgaaaaatgttgtctttttttttttttttaataatctttgaactgggcttgttgtttcagtatatcaaatgtctgaattgcttgattagctcctagctgtatgtttcataaacaaatttcgagctttctgtctccctgattacattttggttattccggccagccttatgtcaaatttggaaaggatgccttagttacttgttgcattgctgataagtttagtttgagagttttaatcttaatgccttccaagtttgaaagttgtttgatgtttggataaacactccatgtgaattaaaaaatgcaatgacagctctatcgactctcagtctcaggttttaagcttgtaggagttgaaaggaagtatatatcttttgctcttggattcgatatagactgatttgcagatcaacttgtttcccattttaagtgttggaatgatatccaactaattatgcatgcttgagtttacatggactgttagttagacttgtggtgttaatccacatgcttcttgtctgtgacaatttcccccagttcattcacgagctgctttaggagatgtagtaattcgcgccatgtgttgcatcaatgttgaagcctgaaagagttgtcatatatttgagttatttcttttattacaggtgcacctatagcagggtctgccgttgatcagattgaacaagtcattggttatgtaagcataggttatccattgggaatgactgcctcaatcctttttggatgacaccataaagccatcctacagtcaccaaaaccacttcattatgggaacacaagatggattcaccagtgtaaagcagctgaggaacaagcttaattctgcagcaggacgtgtagaaacacatttaatcgatggggtaggccatttccagatggaagggcctggttatgatgctgagatggtggatctcatcatcaagtttattgcatcactataaagacaaataactgattgtgctgagtgtgatttgactctgctattgggaattgggattagtttgtgtacaaaatcttgtcagaatctgcgatttgcactgtttatttgtgtcccctaagcccatgccaccttctaaaatgaaagaaatcagttacccacatagtaaccatttctgctgattggataatgagagagaatgggaattgcaagcataagaaccatgcttttcataatttataatttacaaataacatatctgttgtctctctagattgaagctaccctagattgaagctacccgctacactacttaatagatacaaaaagaaactacaattatacaataattatatcatattacaatagtcatgccttgttgccaacttcgtgcggatactcagatggagcactagtttctcttggtaatttatcaccatttgaaccgtctggtactctaacaccactcgaattatactgttgtttcttccagtgtttttcctgatccattgactggtcttgcgaaaagggaggttctacatctggctaaagcaagagagttcaaggaacataaagaatgaaagagtcttgtaatcaataatctaaaatatcaaggaagttatatactagcaaaagaacaaagaaaagaacgtccaaacgtccacgctttattcacagccttgcatttcataaaaaagttcattagatcccccgagttgctggcctactagcaatatccaaaaattaagatacaattcaacagaatttggtgaaatttcaattaattatacatgaacaattttctagttacttagttattaccactttcaccctcagacacatctccgagcctggtaattgcattaacaagagcctgttcatcttcctgcatttcaaagggagagccatcatcattttattttattttttgatatagagagccatcattattgttgaaactaaagatttctcataacataaagttgtatactaagaaaatgattgatattcacttttagcattttctttgctttctccatttccatgggatcaggatggcttgcagtaaacaccttttcaacctgttttggttccattctattaggtaatatgaaggagccaaatatttgtatcatacagagaagtagccaaatttaacacacaaatttggaaatttctgttccagatgcttgtacctccttgataagggtatctgtatggagtatctcaatatcatttgtagccttcttcctgcccctttttgtgacaaagtgaaatctttcttaggctgcaccttcatcattcccctacctcttccagaaccagtaactgcaccaccgtgaggcatagacttcttcaatcctctacctggaccgggccggccacctttaccagatattccaggatcttgaccctcccaacgaatatcttctggagatatctaccatatcgaatagatagtaactaggatttcatcactgattgagttgattgttagcagcaacaacacaaactttagtctaattgataaagaataatgaatgtgaagagacactaagcatgtaactatgtatctttgaagtagaggtgtggtctgatttttaaagacaatcatcccgtatatgcttgaagtttcattgtttgcattaattatagatacacaaaaaagaaatcaccaaagcaaatgttgatccaagatagcaaaaggacattgactatatgccaatcccttcagccacaaaaacatactagattttagttttaggcagaaaaatgttcatttcatcaaaatcatgagatacttaatacccatttcaaggtatgggattcaaagtatgagacacaaggtcaccatgggaaaggtaagatatgtgaaaacaaaaggttctagctatgcttgtcaggagagaaatgttgcttaaaaagaaaagaaaagaatgaacgacgctaaaactagattgtatgtgaatgatagacagaagaatattaatattgtaaaattgacctctttaagattgacccactcccatgtttcatttgctgaattcatatcataaaccaaagcatgtagtccctacaaaatatgtaaatagaaatattaaaggagtccatgcattcctcagtttctaatagtatactataaacacacctcagcagcattgttgttagaggaacaagcttatgagactggattcgaggccagcacctccagaaggataagaaaaggcaagtgtaagaaggaagcttgataattttcatatattccatttgaattacaattgctttatttatactagttcctggcaaacagaatttgtcattttgtaccaagaaatatttaggaaatcattggcctagtgattacggttgtgatgctgtccccccaagaccaaccagccacgcttagcaattccagagcaaattccttcattcgaaccttcttcatacgtagtcactaaggtgagagggccttgtgatgaccctctttgcctttcttgctatctgaacccctctgttctgtgcctgcacctctgtttgatgttctttgctagctgatgatcctcttttcgtatcaattataatccgttataacagcttcatagaagtggtggtcttcaggccaccttgtccaaactttccttccaatccagggatcataagaagctccttcagcaggtccttttgctgcaaaggcacctgaagaaccccctgatcctggctttggcttgtaagtcctgtagaagggaactgtatggacatcattgaggatgcacaaatcaatgggttttttctttagaacgggatagaatgaccatagaggaagtgtaactcagtattttgttatcttgatattccaaaacaaaaaggattactgatttttgctttgtggtcttagttcctgatggaggttcatgcttcaatgcggatgatgatggttgcatagatggatgaactgcaggagatggtgcacccaaggataatgaagccacagattgtgatgtcttttttttcttacgagatgccaaaacggtagagctggtattgtgatcatgaacctgttgagcagtatgtactgttccagattggagcccatttccctttctccactccctaacagcacaattggatacaccccactttaaaatgcagaaaaaaccactgtttgctcaatgctatacagaaactgctcactagaatatgataaaatatagtatgaccttatcctgtggatgatgtcatcagcattgactcttgatagaagttctgtgttcttcatctgatactcttagctccttcctaagctctgtaattaaactttctttttcctaaagtacataggaacaaaaaaactcattgccaatcctatcgacatacttaatagaaagacaaaccaatgaattaaggcaaaggtgcccaagtgattgcatcagattgagctttaaaagccttcaggacagaggtgtatgcttcttgctcaatgttatggatttgtgtttccatgtcgttctgcatccgaggatatggaccagagcctacaattgcagatcttccgtttccagttccagtggcatgatcagggcgttgaaatctatttcgacattgatgggaaggaggaagatcatcatctgttcctgtggttatttcagattatggaaattaattgcaagcaaccttttgaaacgttcactcatataatttccacatctgaaatgttcactcatcattctatgagatttatctttatcaaagaaaatttaggacagtcggacagatcactatcatggtctgtacttaacattgtgcacaacaattatgcctgtgtgatagatatcttgtgttctataacgatgataataattagaaaggagcgacatagatattttgtacgaaaaaaattgctgccttgattgatttgtgtgaatttggtattggggagctggtagtggtacttattttgattatttatggtattccccctgcttcaaatgcttgacaaaaaaagacaaacctgagaatatgctcatttcagttatgaatcagacatgactcatttccactttttggcaatatattctgttcttttcattctgattttacagcaagtgttcattatcaatgacatggtctgcgtttggactaagatgacagatcacgaggaaaaatgcagctagttcatgtcttttgttcttgctattttcctgacttgttctcagttagaaccgttttctttgaaacactataactgctccattatttagaattaaaagtaataagaaaattacaaaatcagccttgactgtgttcatttctaggatttaggatataaataagtgacaccaaagttcaagtcttttaagtgaagacctcaatctatgcataataaaaaaattaggattagcataaaggagaggtcaaacgaagttattcaagtcagttgctcaacacctgcataattttgtaaccatacatacaatataagcctgcgaagaatcaccagtacattatcaaacaattcctaacttgaagttaactaagcaatttgataaagaaaaccaaaatcctaatttccaaattaaggtccaaactcattctagtcattatctattcaaacaccttctccaacatcacaaagcagctacaattattctcaatattgagtcaacatctcaaatgaaaagttcacaaagttgcagtttcaggcaacaaagtttcaacttacaacaataacagcagcagccaaacggtttgttgaggaataagaatagcaaaagggctatttcagacaatttcctcaattttgttcacacggtcattttaatatttgaaattataatttattagaggccgggtctagccaaaaatattagtccccggtacatccgcatttaaaccttgaataagattgtcttttgaagaataatacttataagacactcaacgaaattatttaaaatcatttgattttattattatgtatttattaattttacacaaatagtgccaactaatgtatacccaagaatctgcttggaaaaagttaaatgtatactcaattttattttgtatgcatagagagaaatagacgaggaaaaatataaaagaaaagaaaaaaattataaataaaacaaacaacataataaaaaatgaaaagaagaatagaaggaaaaatagactcaaaatgagattttgaaattatataattaataatccaattaatctcatgagatattattctataactataacttatggaccgtttggaagagataaaaaaagaaaagaaaatattgattacaatatatttttctttgtttaattgaagaaaaataaagaaacaattgacttctaagaataaaaattcaaaacttttcttatgttttaacttttttttaatttcaaattttccttttcttgattttcttttcccactacaattgactgagtcagactgaacgtgatacttagatacatacatgcaactctcagtactactcctcacctctatataatcttcactctttgctcctccttttcttcatccctcagaattaacctcttctcttctttgtgccgaggtattgctctctgtctccccccattttttcctaataaatgcactattactccatacatttgctcctcatctctccccactctttaactaataagatttttcctccgttgtgtatgtgtatgtgtgcataactcgatctcttgatgatttctaccaattggcctcggccttatatatatatattctcattctcatatatatatatatgtgcgtgtagtttacatgaattttgcaggtgattattatttgaaagcaaatttatttatgctgttagtaaagattgcagcaagattttgccataattaaaaatctactttaaccccattgccctgcatgtacattttattattagtttgtttgatgattttggaattttgtggtttaatttattaatatatatatatatatatatatatatatatatatatatgtatatattttgaaggaattgaggagcggagtatatacgatgcagttcggattaagatccccagaagtaccagatgagaacacaatctcgcgtggaagcatcactatacagtttagcttccatctgagtgcactgagcatgatggagtatgagaaccatcggagagtgagaacactgagcacaggtcccttcacactgaaaatgataatgcaaataaactgtcccattcttgctcatatctgttgtgtagataaatttaagtggcctctaacaaaggacactgttgttctccgagtcaccactcgcacctatgtcattgccctccctggcctcttatatgccctccagttcccaagactttgctctcgagaacgtcttcgaatcctctcaaatgtctttaggaaatatggtcacttccaggatcttagaccccaaaagctaggtatctctcttctcattaatttcaactttatttaaattttcgttaccattgacttttattgattactatttgattatttgattgactacttttaataacattatttcttttgactacaggttatatctatccataacgcttgactgttacttagaccttcaactttggattaaaattttaaaaataatttttgaatttttaaaaaatctaatttattaataagaactgctacacatttttttgcgtgaatgcaaggggcaaaagcccctagaactagattaataccctctcgggaaaaccgtggaatttacattagatataacagctgcagcaaagaaaggtaatagaatcataaactctcggattctcaacaagagacatttcatggttagctaactctcagttacctgattcccttccctcaagacaccatgattgaaggcactggactatactaaagaactgctacacatgcgtatttttatttttttaaatgacctaattacaaataaatttgtactaattttcttcccttttgcgattgggtgcaaaattaaatttatttagacatacgatcgaccatttgtttgtcctacatcctattatttattttgagaggatatgtccttgtcctaattatatatatgaatgaatgatgacattgattataattaataattaattacattacatgcaggtgggtgctcaatgcagttcgatgacccagaaatgttggaagtgttacgtcctgattttgagcccatagcacatgaaacccttttggagttagggaatatcccagggatttcccgtttctgcatggaagagcagaactcgagcttcctaagggcgtgtcgcatgtcggcgatgacaaagatgataatggaaagcatgcgtgtgaagacaatgacaagtagtcttgtggagatcaaaggcaccaacccacctgaggcacaccaaggaagagcctatgctgtgatgagtacctacactcgccttgttgattctgctgaatacgcttccctcgtttcctgtggcttagttgaggaattggagaatgttgtgtctcctcttcgctttggttcggttgatgttgggtaccaggtttggaatctcaatcacttgggccttttgtctttcatgtctctcttgggaccccatgttgaagaggaagtgaaatatgtgagtgctagagaagagttgtggaatgccatggctgaaactgaacaggaagaagaagctgatgaggcctctgatcatgatgaagataagggcgaggaaacaaattaaatatcaatacataagtctggctagatcatgtatgaggtcttggattctcacatttatgttcgtgtaataatttctctttaacaagagatcgagggtaaaacatatgtcttaattaatttttcattttgatattattatatattctctactattataatatgatgaagaactaaatcatatgaattgattgattttttaaagagtacaatcgtatatatatggagagagaatagggaagtgaccatatgggatgaccatcacctagtaataataaggcaagctaaagaaatattatcatgataactgttgggaaaatggaatcggtcggaagcatgcatgtggaacagatgaaattaaagctagcttctcaggaataatatgaaaatctatgtcaatatgctagcttttcgcaatcatgaaaattaattagtattggatatattttcgatatgtcacaatacaataatgcaggagtgaagaatggaataaataatcttgtagaaggtaagtcagtcattgaaactcacatgtggtagagagggctgaaaggctaaagcacgatattatatacacgatttcagacgaggagcaagacagtacatatataatagtattctgtttcttgaatttccagaaaatcaaagagccatcgaggaacacacagaatccggtgttgtatgactagatgccaaatttgaattactaaatgcacgtttagtattgaagcgaatattcctcttagctgccccgaaatgatgaatggttggaacctggttgaaatggctaagatgctaaacatcatataggttattatatctggtcttatgtttgtcaaatgaagaagacgtccaatatatttaacttttcccagctagctgctgtaacatatattgtttttctcgatatatcttgaaaggtttttaaaaattcaaagtgattatttctataaaaaaaaagtttctaaaactacaaaaatgttgtatacattaatataattaataatttcagtgttagattgattaaagttcgctgatataacttttatttaatgaaaattaaattgttagtacaaatattgcaagtctttattaataatacaatacatcatactaacatatccaaaatatttatactaattaacagttcaatcctgctagataaatgcttttctatatatacactgacagaacagttttaatgcttttttaattttttcctgtttgtaataatgattttttgtttgtttgttagaaattgacatttttttcactttaatcatgggctaaatcttttatagtaaacaaagaatataaaaataaggaagtttaacttagtttgtttcaacaatataagtaaattattgtaaattctcttatatctgaattcctacatattaaaaagaatattacaaaaataagatgtatattaatttgatttgataaaaataagattatgcaagatttaattaataaagcaaaataataaaaacaattaagtcttttaaaactatataaagtcgtctatttgaactaaagttatcataacattttatggtgaatcatgtgcataaataaattattgatcttttaataattatttttaatggattcatcaatagtttttctcagtatccttctacctctagtaatatggccatcatcatcatccttttgatctactctcttaattggtattttactagtttttacatagatgtcatgtctacataactttatctttactatgatttttctaacaatatattatcttgtatattcactcatttagtgcatccatatttgtaatatttgtttttattaatgttcaagacactccttttttgttttttaaagttaattaagatactcattcatttcatctatcatgcttaaatcctctagttaatttacatttctttctcattctatttgattgatggatccaatacttcagcatgatgcatcgtattattggtgacaacttataatagtcatactactattaacaaaagataaacttaacgccttgtgcaaaagaagattactatcttaggtgtagtgtatattttgtgttgttttgtcattcggaagataataataacttatttttatcttactttgcgacaattcaaaatctggtatgtaatttgtgtatgtcaggtattttgagatgttgcataataatatttccgcccactatatacaatttaactctctttttggaagaaaaaaagttgaggattaattgcaacaactatatggtgatccttttaacttcaatacgttttcgacttgatcgataaaagttagatcataaacataatttaaggtcatgttcttttttctaatggtgtattgatatctttatttatccctttaattttactttaattgtaagttagactttactttcattttaataaaattttactattaaaaaaatataaacttatcccttaataagtgacatttgtttttgtacaataattaatgtgtcttattttaagtggtggttagatccaatttcatgttgaatttaatattgtggaacaaaaaggcggtgttatatatatatatatgatggtcgatggtgcaagaggggatcggaagattatacttaaagaagcagaagcatacttgtactccaatctaataaaaatgttctatatataatagaaaatacggatacgtgctgtacaggaaaagaaaatgaatatgtaagtatgattcggaatacatatgcaccatgacgcttttaatcatggatacaaagcagcaaagccctcttttgacataacaacacattcaattttgagacatgcatgttacaaacgactaaaagcccacgccattaataacatcaacagtcttttatcacttctatatagtaactaaacaaggttttttttcggtgagcttaggggagctagtcaaacaatcatttaaaacttaatcacacaaaacatgtagaggtatagaaaaaatacaaaaggtaatggtgggcaagtgaaaatccatagttttggggagttatttgtatcccaaagtcgaaaaccattatgccctaaaggcattatcggatgtgactccttgttcactacctggatgcaccttgttctttcccacactagaactagccacctttctctcttcagtactcacctcacctcttcgtactctttccacttccattctcttcaacttctctttctgcctcttctccataacataaatttcagctgaacgtgccccaatggaagacatgttgttctctgcaaaaacaacaaactagctaatattgcaaaaaagtttactaattattagacttggctactaagaaatgctttatgaaattagcattgccaaagatggtatttataggagttggaatttgatgagagcgtgtggaataagcagccacgttcatttctccaatgcccttgtggtttgtggctttgctttacaaccaaccataattaacattaattatcttaattgcactcacacaaaaaaataaaatgccatgttgtcatcatactttgcatggaaaattaagttttggtccgcgcaccatctttatgtgttttaaactttctaaatatataagatagacaatcctaaggctccaaatgcaacaatttgtattaatatattacataagtatttaaaatacacatggtttggatcacacaggaagtggattaaatataaaatgaccgaagtgggcttcttagtttaattatgtgtcatccaaacattaaccactattgccacacagatgacatgtcagcttgagatgataatatattctgtgggaggagttggaggctgcacaatggcagatatattgcatgccgctgactactggtaagttacctccaaaataattgacctataatattgcaaaggccattaagttataagattcaagtgtttcaagcatatgcagtaacctaaaacgggtttatatataacgaatatataatttctcatcgccgagtaacagacgtacaagaatgagacagagagggaatgtaagaatcattggtacttaaatctttgattacatcgatgaacaagcgaatttcaggttttagacgggatgctttaattttgtttattattaatattagttcatacacgggacactttaattgatgaccactaatcgtggaaactgcagcttctgtattagcgttttaggtaggattttaatattatgcacagcaccaactaagcttttagacgtatattattaaatttatatcttaaaagcataagccattaactgacagctaggttatcataaaaccaggagagcttatctttcaatctaacactttgattgcatggtatttctcttcgatctaatttaagttcttctttttcttcagtgactattaaataaattgtattaaataattataactcatactctcgatcaggtcaacttagcgaaaataagattggatgatagtaatatatatgttagtagtgtacatcgatctactctaagactaaagagcgtgtaataatataactaaccagttgataagattcatattttacaagaggtgaatttaaattcgaatgtgtaaatgtaaaaacttcgttggggagtaatttaaaaatacttatgtaagtactttgagttttaagatctgttatgatccatgtaaactttcattactcaacttacttcttttttttagtgaaaaaaaacattatattaatagcatattttcaaggaaaatatttatcatgaatccacttactttctctttcatctcatttctactttcattttcttaatctcagttttttttattggattacctattatatctatcattttctccctttattttttttttcttcttattctcttttctttcctccctaacacaccccattttaggatgtaagtttatgattactttattttcagatacatcttacaataaagaaaaaaaaagggataaaaaaaaccatatattactagaaaaaacataaataaagatggaacttagagagggatcctcatccgtctttagtagagaccaaaacagtgacaaaatgcaatatacagaaatgaaacaaaaatattctaccttagagacaacataaggatatatccgactctataatattccatcgtctctatatgtttaataatatttggacacagattttagtgacaacattagttagtttgggataattgtcaacatagcccatctctaaactcgtttctatgtatctattttaatattttaaaaattataattcattagagactgaaatgattccgtctctaagattttttatattaccatttttatctattcaactagagttaaagtatatgctgtattatagtttgattaaaaataagtactcaatattaattataatattatataattaattgggaactgtacacatgccttaatataatattattttattatattatatatgagtatttatatttttttaatgtgatggaaaaaagaagataagaagaaaaatcaggtgagatgatacaagaatatatatatataataattccaaatgaaataccacaaacattatattagatacatgttgacatgaaacaagtcactccaaaaataatatatattttcaatttaagcttattgttgtaaataataaaaacttgagcagaagaattatagagatgcaagttgctacatatggtcgataaccatctcaaagaaatccttttggtcagtctgttggcaacccaacatatcattggtgatttggtgtcctgtctagtaatttgagattgtctatccgctctaccactttctaaacaaaaataaaaaataaaaactacctcaacaaaatcaatgcattaagcggtagattctgcatacagtagtatagcactaccaagaaaaaacttcatatagcaacgttgctctcgtaatatcacccgatattatttataataagaagagaaatagaaagaaaaaaaattggtgatgtaataatataaaaagaaacaaaaaatgaataatgaaaaaaatataatttactctttctcgcatagaatgggaagcaaggacctcccagaaaattttgaaacgttaaatatgagtggacatgggaagatgtgataaagatcgatccgaatagcgtattaggaggataatttttataactttttaatttataattgttacgagggctaggtagtgactttttcttcttttttttcaattcaggggacttgtgctgttgtgcagtgtgctgcaaaaactggagttttttggtgtcaaaggaaaagaatcagaccagaatgaatttgtgcctagctaccctgtattgacgaagctactgtatgcgttggggaatagcgcaaataaaatgatttttttgcaacttcgagtcattccagtcgcagtaacgaaaagaagaatatataggaaggttcatgatatatatatatatataatcatatcgtataactttcataactattatattattttttaacttttaattaaatatttaatattttcttaaaatttatcattaaattcaaaattcattttatataaattatatatacaaaatctaatattaatctaaaattatttattattttgtttatatagattaaaattgatctatatgaatattttaaaatataaattattgattatttttttattgttgttcaattttaataaaatttgattcaaatgatagtaataatatatagatataatttaacgattagattaataaaaaaaatatattatatatatatatataattataaaaattatatttgtataatttaatccgactttgtggctatatatgtgtgtgtttttgttcatgttgtatttctttctttctgcaaaccatatagcagtataagtgttttgtaatgtacatcgggcacaacttgtgcttcttattctttttaataaatttgatccattagctgttttttaaaaaaaaaattgttgaagataagtacgtatcaaattttcttatataaattatgtatcaaacgacataaaaaatatgaagcagtaaaattacaaatactttatggcaaatgataaacgatatcttaaaagtattattaaaaaacttaaagtaaaaatatttttattagaaggaaaaaattatattatttacaatattttttttatcattcttttagaatttacaaaataaattttaatttcttaaacagatcactggtatgcaaaatccatactatatatatatatatatatatatatatatatatatatatatatatatatatatatatatatatatatatatatatatgataagaacctcctcccttactactccctatgcattagttgttgactaacgccacttaccaccaatctcaagtgcttctgactaagtccaattaataaaggcacaaagcgccatcgtgccccgcacaatttatgttaaaaatgaatacaaatcgaaaattagggtaaactgatgtaatttttagtttgtggctgctcaaagactgcgagttatatataaggatgaagaatgtgcaatgcaacttcccaagtcagaaaaattccatgcaatcagtcttcttctttgattttatttttcttttgcttctttataacgtttttgacttccgtgaagtggcaaaggcaacatattttgtgtattttattttttctagtcagaattgagatactttttcttcaacaaaaaatgccattctagtattattccaatatttatactgtagtaattcttaccatttcgtccacttaatttgaccggctacccattcctgttctaatttggctcaaccaccgttccgttttaagaattttgatccaaacgcgcacgtcattccaataattttataatcttaatttaattgttttcctccttctcgactgcgaccaaagtattcaattcttaaaggattgataagacaaaaagagtattacccaaacaataatgcacataaatagtgcttagcacctaagtcaacactgtacacctaatcacttgtttttaaatcaaaaaatattttttttatacttaaaaaaataccgtacattgcacgggtttggatggtagtttgtatcaaacaaattaagcaaagataagtctaaccgcttcacggggcagaacgagaaatttttgtattaaagtcatgtgtttatatgtaaaaaagcaaaaaaagtattagtgcattagtttagttgcatttagttagcatcaatatgaaacctctctctaagctcttaaacaagctttgtgggaaaatgataatgctattagcatcccttctaatagagcttatcattctcattcagaagctaagggaatcacgtcccatcagcacccgccaatacatcaaactcatcgagaagaagaaccccacaatttgctacaccaaaagatttaacttgaaggcagagcacgctacagagtgcagggtatgcttgtccgaattcgagcaaggggagaagctgaggaagctcaaatgccaacacacgtttcatagggattgtttggacaagtggttgcaacagtactgggctacgtgcccactttgtcggaaacaggtgttgcctgatgatgttgtgttcaagcaccgtcagcatcagaatcaaccagaggctgcttctaatgggaatcatgacaatcttctctatcttttttcagcatttcgtggtggcaacacttaatttgcacagataactctctctctctctctctctgaattacccaatgtcttcaacatatttatagtagtactatatagttaaaacaaaaccacctaattattttttctttttagaaaagggtttaatttgttattcttcccctgccaggattctacggaggaatattaatattgaagtacaccctatagatatagatattattaaagcatcgatgctaccttttttgtatttcactcttcttctgcttattatttggattaaggtttgactgatctagaaattcatattcatatgtctgtgtaagtggacattttaattttggggttagaaacatccggcaattgtgatggaggaaacccaacttcctactgacggtagagttggttggtcaaatgaggtagtggagtctctcagacacatattattcatattctactcatattctacgaagaccctttcttagtatactgataaattggtaggtgaataagttgaaaaaagatttttttacatccgttgacgcctttagagagaaacagagacaagaagaaaaatatagatatattaagtgatatgatttaataggaaaaaaagagatatatagaaaaaaaataagagggtcaactaggtatttaaaatttataggtataaaaaaatcaggactcgaataagtttatggtttgatgtccagaagcaattcttttggattttcataaaagttgctttaatgttaatatggattaaaaacaaatattaattaacgatatattaaaatgaaagaaagttagtgaattttctcaaaagtgaaaaacatagaattatacagttacacatgcaacataaaaaaaattaaaacaatataggtttaggttgtaatttgttgaaaaagattatgtttggatcttctatgactatgagcacataaattgtgcttagcaccaaaagtcagtaaaatttgcttaaaaaagtatttcaaaaatagcaaaatgatacttaaatctatttaattgcataaatccaataaaaagggttaaagaaattaacatcctaagttaaatatatgcttaaaaggtaagcgtaaatggtaatgataattattgataagttgtctttcttcgttccaccagcttaaattaacttaggtcatgtttgtcttcacatagctaggaaagacataagtcctcatcggtgatctcaacttaacagacttgacttagaaatagacgttgccatcgctttcgatcatttgctaatcatgtggcagaaccaaattaaggagaatatgtagcctaggacattaattattcaatatggttgagaggtagatggacaaattcaatatcataggacacaggggatgcatcaaactgacactttttgggatcaatgaatcctcaattggtttttcgatttctgtagcagtaaagtgcgataagaattaatttgtcaatcttcatattttcataaataaatttgattatttattcttatattatgatttgtttgtcaatgaaacaatataagaatgcatcaaacagtgttgaaagtcgtaggttttaatggtgcactcctatcatactgcaattagctaggttcttaactagtctctgacatttttcaacacatttgcttggacagttgggcaataaaccaatgggttttgatgtaaaaaaccaatgacaacaacttgaagtaggtttactcttcacatgcatgtggtcgatgttgtattattgattatatcaaatgctattacaattttctataagttttcctttgcgtattggcagaagaataatcaagaagggttctcagttatgaactttgcaagtacatatgatgcgtgttccctaatccttgattacagacatttcccctcaaattgttcatccaaaatgaattatttgctccttctttttttgagttgaaagagacataagttcaacgttgacttatttcctctacatgtattcacatcacatacgtgataaatgaattgtagtacttacacaatttttttataatattatttttatttttttctattacatacattaactatattatcacacgtcccaatctcgctcttttctttcctggtctctttattatacatattctgttatgaaaaattgtataaacataatttgtcgtaataaatttcaaattacaaattgtaactgttatatatttagatgaataattataatttctcatctttttttttaaataatttttcttataattaaggagctaaaaatcactcttagaatgaataatgtgagatgcctacccaacctcaaaagctagttttgatacgatgttaaagtgcagcaaagacatctaaaagatttttttaaaaatcaattaataaagggatgacctatccaattatataaacacttatcatattcattaaccacccgatacggctctcaacattcatcttagaaataaaagcttcttgtatatcaccaaaagtttaaacaaattttgtggacaatgaaggatcattggataatcactgtaagcaacttggtcgtagtagagtcagtactagtttttattcatctactcgattatactagcaatttctatttcattccattgcatgtattaaaatactactagattatatgaaaatgaaagtcactgggttttattatcatagtgggagtggattagtggttgaaatggtagctcaaccgatcgatgtgacggttaagaagtgtcggtcaagtagtgaacacaataattgatttacaaaagcatatgtactccacccactaactcttgcgtgctccttgtttcaaacaattaaattaatataagggtatttgttagtgtttaggatattggttaagaaatcaatatatatatatatatatatatattgtataaattataagagaatataaaaaaattatgaatagtataattttttgtttttcaatttttaaaattttaattaaaggaaaattggttatatttaaaattattctttatgtagaagaaaaattgataaatgattttgatccagtatatgtcccaggggcaaggggggaaataacagaggctatagctcttcaagtactgattttcaggtactttgttggagtgtgattctaaaatcgtggttcagtttgttaaccatgcgtcaacacagtactcttcatctttattagtctatcgttacctctattcgtcattggttggacaagaactgtgaggttcatattgtgcaagtttttagaaaaacaaccatgaaccatggatgctgatttttttagcatcagaagctcaattttaggagatataggagttcatatttattcctaaaccatcagaacttgattgacgcaatattaatgagacttccctaggcctggtctgttcaatttgagatactttctttctcaatttttttagaagaaatagtagaaaaataaataaattatgagtctctggaagaagccgtaggaatataaacttgtagatgcatccacactccaatctcaataataacaaatattccaagtgaagtaattattgaaattatgtctcatttgttggtgaagtcgctcctccaattgagatatgaaattttcatgactgtgagaagcgtagccaagtgtccaggttatgtgtgactacgatgtcactgacatgaactatctcaaacaatgcaaaaattgtccccttaaaggcaataccccctttcccccccttaaaatttggctttcaaaaagtacttttttcaaaatacattaatttttaacatggctagaaagtatttttgaaatattaaaattttaacacttccagaaaatattttctgaaatgtgttgaaattttttaatctgttttgaaaagtagtttccaaaaaagagatacttgtagaagaagaagaatatatatatatagtattagtaaatctgggaggtgtaaataacagttgttaccacctaatcttaggctgtaacttggtccacgatggattggattttaatctcaaaggcctagtacagtcgacagatatatggcaagaatttttaggtgagcacacttaagactatgttgaatatatggaataaaattttccaacttcaaatttcaaacaataacaaataatccatgaaacaaacgactcctatactcttattgagtgttgatcattgatttaagtacttacaattaataatacatatgaaaagaatatatatactatcgaagaagtgaccagccataaaagtgttggatttccataagcctctcttttaggcccaatatcataaaagaacgggtcgcacaggtccaaataaaacaatagtgtcccaagaggtggcccagcagtacacaaagagacaacaaggctttgttattctattctcccatccaagttcacaccccatattttcttttatttttttaacaaaaatatccttgacagacacatttttattatgtattgtacaaaaaaatataatataaaaaaaacaagtatttattgtgttaaattttcattaaaaaaaattaacatgactgaaacttattataacttttttacaaaaaagtaaaatgacactattattgtgagtgaaaaaaggtgtgttgttgtaattgtgagaaagtaagtgcagaatgtggcgtgagaagaaagtgatgtaggaaaatggacttggtgagtgagaaagtatgtgttactgtaaatgtaattgtgagaaagtgagtgtggtgtgagaagatattgatgtgagaagatgggtgtggtgagtgagaaagagtgtgtggtgctgtaataattgtgagaatgtgagtgtggtgtttgaagagagcgacctgggttgttgagaacataaacttctttttgttgttttagtttaaaataatagcaatacaacggaaacatttatgtttttgttgggttaaatattttttaaaaaaaaataataaaacaaaaactagttctattttgttcaatcaaaatatatttttgttgtgtattaataagggttatcatacattataatagaaatatattttcattataatagaaatatattttgattataatgaattcacaacacaacctagtttttaaaataataataaaaaaaagctgtggtaagaggtggaggcaatgggacccataggggccatggccccctcccctacagatttttaaaccttcctaatattatgtataattaattaatactacttttgatgatattatttttcctttggttttggtcaagatgtgaaatggtggtgcatgagtgtaggatgtgcaacaccaaccaggttttacaattataagtctttaggcatttgatgttttcagactctgtttaattggtctacactacttgagttgtcaagttgtaatcattgccatcttaataaaattcactttgctttaaaaaaaattaatggctctgcaaattgtaattatttacacctcacatatgttctcattcctttttctttctaatgtgtgtaaaggtttttgcattgcatttcattaacttgtagaaaaactagttttgaacacataaaacaactagtttcttttaataataatgcttattagatttatagtttttgtttttactaacaatacatttatatttagctaacatgtctaactgttttctgccaatttttataatacctatattcatgtaatgaaactcctttttcactaaattaatttaaatttgttgtggttaattttttcttttttttggttgagagatgtttaagaagaaaactatacatatagtaattttataagagaaaagaaagagatgatgaaaaaacacatatggtgtctaatgcatttacttcaaatttagatactatgtttttattgacattattggattgaaacattatactttgataataatgagatgagtgacttattgttgattgtatttttgaagtttcatctctattttgaagataagagatgctatcttttgtcacactttttttaggatattgttgtcagttctttattctcttctattttttttgttattcatcattgtgtgcatgtgtattgttggcacttattggttaatcttctttactcaatataattatatatttcttctgcttataagaaaatatgttaaatttcttgcatatattatgcatgtgaaaatttaattgttttttttttctaaatcaagattttttattagccccttaataaaatcctggctccacccctggctgtggtgtaattgtgtaaacttagagaaaatgtgttgagaataacacggttcaggggacagtaatgcaaaacatgtacgcccactctgctaaaaaagggcatactaaaacaggtctgccatatatttacttctgtttttcatgtcctgctaatttcttgtttaatcaaaatatctatactaatttcctatagagtttacactaaaatttatttatatcaatacatatccctccaactccaagagtacatgtatgcatgtacgtgtgagtaatgagtttctttataaccttctagaatcccagacaatctaatcaatagtttaaaaattacaaaacataagatcagatatgtcaaagtatatatataaaaaggggcaccggagatgttaaacggggaacacatttgcctttaattcaaaacataactatgcacagtaacacagagaaacatagattacaaaaggaaaaaataataaaacaacaaggtgccaacaacagccaactattgcaaccagcaagctgaagttgttcaagcagaaaagaaactgttagaagcagcaattgcaaattgggttttgggttccaaaacccacttgacaagctccttcttctgcacctcaatcttctccttcagaaccaacaaagaagcacaagaaaccacgttcaagttcctctcttgtacagcgccagccttcttaaaattcattgtcctcctctcatattcttctgctaccaacatagcaatatcagacatggttgatggtagattctctcactcactatatatgaaacgatgttgtttgttgtggttaagggttgctcttactaaaaccttgttcaaagcaaaagctatttatagcgacggattctacgtctctacgcgtggccggtcaacagtttcggataaggctcaagccgtgttaggtttcgattattaaattattactcattactatacttttttagttggggtgggtcatatccattaatgtgtccttcgttaaaaaattctgaagactttccgacgaaatatagaggactaactaatgtttcttcaacctacccatgttgttcacatgccctgaatatgataggacaatttggacagatctaatgtgggagaattataaaaaggggactgaaaataagaaaatgttttcatatataaatgttgtacaaaaaattgtccaataaggaaaataagatgatcgatgcaataaaaagaaaataataatattataaaattattgtttcaatcaatttgtaaataatagaactaaaaaggagtttaacttttaaagccaaagatggtaaatgtaattcactttttaaattaacaattataattcctttttcaaaaagtatatttttactttttttcatcattaattatatttttactttaaagaagttaaattttaaaaagtgaaatgtggtggtaataatccaaacaagagttttgcatgatttgtaaaatattccattctctgtgatcggtcatcaaattggaaaatgacaaaatattgaaacgtgggacacgtgtaacggtttctcactgtatacgtagtatagagacaataagcaataatgtccgacatgcacatgcccaagcctgtccctatcctttttttttttcagaagggatcattaactttggaatcctaattcctaaaaatgagatacagatatacgtttttaaaactacggattggtccgatggttagtcatattgaattcaccttatggagaagatatatttagcacaaaattttgtatttatgtgtgaaaatcttccagataagtgaaagatacaatatgataagtggaattagttttgggtttagtagactgaaggatacccttgacaatatcaaaaaacatattttaaagtagaaaaaaatgaaaagaatttaaaaaataataaaagtaatgtattttttggtatagactacatgtttaggatttaatatgcatattcagaaattaaacttgagatatctaattaaattgaaataatatcatactagttgatctaagcgctcataataataaacgtgatgtaacttcttcttactttgatgttttattcaaagctaaaaataattttaataattgtcttcatatcatcaataaaatttctccatgtgtttcagctaatgataatgactccctcttagtgtctttctctattgatgaatttagatctacactctttgaaatggattcagataaatacacatgaccaactggtttgaaaccaacctttttaaagaaattttggcatctttgtggatctgagctctttaattctagagtctcatggcttgaaactagccaattcccacctcaggtaaataaaacaacaatttttctcatccctaaaaaatctaatcccaccaccatgaaagatttttgactcatagtcctttgcaatgttatatacaaaattatgtccaaagtcctagccaatggccttaagcttattcttccaaaatgtatctctcctaaacattctgcttttatccaagatcgttccattttggataatgtccttatagtctctgaaattattcaccacataagatgcaaacaaaaaggaaaactatgagaaattgctttcaaaattgatatcagcaaaaaaatttattgagttgactcgaactatctttttggcatcatgggtaagatgggatttaacaaaaaatggataaactgaatgagaatttgtttcccatcaatccaattctaggtggttgttaatggggataatgtgggggaaatttttcgagggagaagacgaaagatagaatgactcactaccatcctacctattcattatttgcactggggtctttcaactattcttaaaacacggggaggtgagaggtgacatacatggtgtgaaggtgtgcaaagggactcccctcccccctctcacttattattgctaatgattgttttcttttttgtcggcctaaaaataatgaaattttcaccctttaggagatcctagacacttatggaaaagtatcaagacaacttatcaattttcaaaagtctgaaatctttttgagttcgattattcaacaacaacaaagacacaaaatctcttcctaggtgtcactaaaagcattggatccaacaaatatttaggacttccttcaatcattggcaagagggaaaagctatttttgggttcatcaaagatcgtctttggaattggctcaatcattggactagtaaacaactctcaaaagcgggtaaagaaatcctatcaaatatgctgctcaatctatacccttttgctgcatgagtgcttttttgctccattccactttaaaagatgattttgaagaaaatgatgaagtgtttttggtggggcaataacaacaaaggaaatgaatcaattggctcagttggataaaattattataaaaaaagaatttggaggaatgaaattaagacacttgtacgcctttaatcttaccatgttaggaaagcaaggttgaaaattcactaccaaccaagatactataatgttcaaaatcttcaacgctaaatatttttcatcaatggatttcttggatgtccaccttgggcacaatcccatttttgtatgatttagtattcacgcttcacaggtaatggtaaagcaaggtgttattggaggattggcaatggtgattctactcatgtctggactcaaccttggctctaacaataatcttaatccttttgtctcaaccaccccaataatggtatctctcctcttaaagtttctgaccttattgatcatgctaattgcctttgaaggaatgatattctagattcaaacttcaaccaagaggatgctcaaaaaattcgttccctaacactattgaatatcacggagagagatcaactaagccggaaatattcaacgaatggtgagtacactgttaagagcgcatatcatgccattatggatcatttgctagacaatagccacctcaaggttaaagggaattggaagaccatttggaatcttgttgtgcctcaaagaataaagcacttcacttgaaggcttcttcgaaaatgcattccaacaagatccaacctgcgcaagaaaaatatcctctatcccttacattgtgtttgctgtgattcaaatattgaaaatgagtggcatctcttccttgcttgtgatcatgccagactcatttggcaagctgctgacttatggaatctcgctgagcatagatgggacaatgcagataatttccatgattttatgtttgattttctataggaaagccatcttttatggccctctctcttgctatgcagcatttggcagaatggaagcatgcccgtgccttgcacaaccaataacgtccacctacaactcataatggcacagcatcataaattcctcctcaccaaagacatatcaaatgtaatttggatgctgccctactcaaggattctcaaacctttggcataggaatgtgcttgcgggattctcagggaaattttatcaaagcaaaatctgctacaattcaagaacatccaaaacctgaagttgcagaggcatgggctctacaccagtccatcaattggataaaaagatctacaactccagaacgtgatttttgagttggattacaagacggtggttgataatttgatcagttgttctacaggaaaatcagacttatttacaaagatgtagagcctccatctcttctatcccaaactcaaactcaagggtgagtgttataaagagacgaggaaatcaagcaactcataacttagcaagagtttctcgattttatgttagctttggtgtcttcaattacatcccaacttgtattgtttctcatgttatgaatgaaatgtaataacctatgaagtaccgataccaacacggacaccggacacggacacgtgaacacctgtaatgttaaaaatatagaacgtagtatgggtgttggacactggcacggacgcgtgtcgaacactagacacgacaagaggttagaatattcatgcttcatagataataactatgtttttcatttaaaaaaaacatgatatataaaatatgataaaaaataaatataggtttgatagtgtcttcagttacatcccaacttgtattatttctcatattatgaatgaaatgcaataactatatttttcattttaaaaaaacatgatatataaatgtgataaaaaaataaatataagtttgatatattttatttttgtcaaactactttcttagtgtacaggataaaacaacagaaaaatacaagaaagtaaaataatagtgagaaataataaaataatggaagatatataatagatcatacaaacatccggtcaaaacaaaaagatgaaacaaaagagagaaaaaaaatgtaataaaataaaagctagaataaaaaaaaagttacatgtatgaatatcaacatcctttggccttaatacgtgtcacaaattttcaatttgattcttacagtaaaaaaattactaaattttatttgccaaaaattatcaatttaattcttatcatcatatgtcaatcaataaccattgatctccttacctattcttaatttagtttttataatatagagcatttctaattgtatcgctatatatatatatatatataaataattgtatcgctataatttattcttaatttggtacccgtaaatagaaaccaaatttagaatacactattcccatataaaatcataaaaaacaattcacacaagtgataaaaatttatgtctcttaattaaataattcaagatttaaatcctaattcaccttttaagtatgaaataaagataaaaatatacaaattttgagtagtctactagtcgtacaaacactaaattatatatttaaacgcaaaaaatgtacaccttatcgttatattatagccttgatttataacaataataattacgtgtcattgtaagtcggtgatgaatgatgatataccatatatgcaacattatacacgtggctattttcgtaaaactccaatccaaataaaaatccgtgttctgaatcagtttctgactcgatcacaaatccgttatttttttaggaaccacaactccgatttatcccataacaataagtaaataataagtaaaatggacatgagttttagcaaaaaaaaatagaaaaactaagcatactaaaacattatcattttaagaaagaaagaaaaaagactatcataactgattaggatcataaaatttcctgaaactccaaatttcttctttgtgcaaaattatcaatataatcctctttgttaaaatcaacagcgttatgggatgcttaattatcaactcaagactcagttaatgacgttaaagccaagaagattcacttccattatgcgggacaacaaatttaatttaacagaagcaacatcatcataactaaaaaaaaaaaaaactaaactgatgagaaagagaatgaaaacaaaactacgacctagaacaaacacaggaccaaacatatatttttcctcactctaaacaatatgcttttaaaacggggcaactgtacgaatgaaattctaccgctagaattctttgattagtaaagtaatccaaatcaaaaccaaaatttaaaacaaatgggacaagcaatgaataaaacctgattacccaagcagaatcttatcaaggaaaagaaatgatgtacctgtaacctgttactggtcattaaaagaatcctcttccattttctttacataagtagaccgtgtcagacattcacaaatttccacatatcagcggttcagcacaagcgtacaactctagccacaatgaattgaatggctattacacaattatcaattaactgcgggtcttcatgaaaaggaccagcttaccaaaacatggggagggccaatgtatatctacttccattcaagtcatcaagtagatgactgatgactctttcaaactcggactcatagtaggcctaatgttttcaactgttgaatatgctcgggtggaagagccgggggagaccaatccgatcctgtcaactctccatcaacatcttcaaccacatactcctatgatgagaagcaataatagtttcacaatcaacaattcaagacgacgtcagaatttttcagggcatcatgatgttctcataaaacatgcagttaacacatgggattatcagtactgataactaatctcaaactgcttgtgttccatgtcaaatgtaatccagaaagaggccgcccaaaagccagccttaaggcatcaaaataccagactcaagtctaagctcaattactatcacacccggataagcgaacgagagttgcaaaatcaaatctaaaacacttgtcatatcagacagacaaaaagactaaggagagagaatacatccaacaaaactcttcaaataagttgatgcagacattgttagcaatgaataaaaaactcagatggtaaacttcactaacaaattgaatgcaactccaaacggtgaagacccatcaaatccaaatctcgaaactgtgggtcaaatcacatcctctccagccaatcttgtctgcagccaaatcataaccgttgattggttattgcacattaattcatgcagagagaaaatattgataaatggtccagattttggctgcacagaacatcctgctgcagaggcaagagaggatcctgatccacagtgacatatctgacaaccgtatggcagcctttctgttacatcagtgcttcctagcaccacagccccaccctagctaaattatacaggcaatggaagagcaggaggggattgcataatgcatactcatgtacttgggatgggtgtgtgagtgaggataaacttgaggaattgatttgtaacacagctgcacatgcagcaggtgggacgaaggagttttgctttgagaacagaatcaggggaagggggagggaggaggaagtgaggcaagcatgtactgagcaagagacagagaagaagaaaagtagacccatcaaagagtctgacatatttctgtatttacttcttttggctgagcttttatacaattaaagatcctcatctatataatggtatcatattcatatcagtagcaaagatgcatattattacgagagtttggaagtactttccacattataattccagttctctgccaaatgtcaataatttattatactagaaaatccttttgaagtcaatcaaaacagctacatcaaaagcaatgcatgttatataatggtaagctagtagctgaaatacatttactttcgcaaaaccatcaggcatcataaaaatcctcagtcaatatggctctaatgcaagagaatctaaaaaacaagtcaattacaaaagcagaaaaaattatggttgagattcttggctattccttccctggtaaatgtttctgtgaagatattatataggacttaaatgctaaaaaaaacccaagtgatggctaaatgggctaattgcatatatcagttaggaatttagcatgacttgacagctgaattgcaacaagaattgacagctcatagcaatgcaccaaaagcacaaaagatgagaaagtaaaccaaccacacctttgttaacatcctttttgcaagtatgtgataatgacgttgccatatccgttgacctaccatggtagcaaccaatacactgtagaatatcccaattacagtaaaaagtcccagaacaatcaaagccataatgaataataatggtagccctgcttccccagcaccccccaaacaaccaccacattcagttgccatggttccacaactctcaaagcatgtggtgcaatcagtccacatacaaagagtgcctggcaaatgacagtctgcacaaactctgcaacaacatacaaaacaaaaatcaaacttagtcacgaatcactgccattctgagtcacaaacttgctgctaatataacctaattcattaataacacgacacagccttctttctctgtttagcataagcaagcatgaataatttaacaacggaatattatgtctttcaaaaaaaagttattaaaagaagggtctgtgatatagtgtaaattaaatctttatctttatatattacactccaagcatagtttctggcatcctacaattaagcaagaaaacaagcattataacgatgcctcatgcagatgctcggagtttcatcatgtgttctgacaatatcagaggcttgtgaatttgtaaaatcaaggttattacccaggttgacagcaacaaagacatagttctctacaaggctgagctaaatcattgcgtactcttcgatcatagcaggtaatgaagcacccagaaaggccaagcaaggcgaaaaacaatagagctcctgcattaaaaaataccaacaaaacatcaacacaaaaaccagtatctttttaaatgtggaacaaggaaactatgaactcaaggtgatggaggaaaaaaagaatttgcagaaaataatgttgtataagcaatttgatgacaccgtttaagctaaacgcaatttaccacatatatagtaaaagctcatttcactatcaaaaccccagagaagacgaagccaatattgctggtaaccatctattagataaaccaaatatgccagtgaagcaatgacctgcatataaaggtaattaaggggataaattggatcacctatatgcattcataaagtaaaaatggataagtagatggaaagattaatggaaacatatcacctacaagctggacagacagaaaaataaacaaaatatctctggtgacaaaaaaccgaaatttcagggtacgccatttcctatcagcggcaacatgaacacgcaaatgataaggagccttgcacgtagtgcagtgagcaaaggcaaacccttcctgcaataaaaaattaagtattatccatatatttcttaggtcaagcaccgcaaagtacatcattttacacattgttatttaatatggaatatccaggtgtttctccatcaatggttatttactcagtaccttacaccccacaatgcaccatatacattagaggattttttttccaaagaaaaattagcttgttgtctacagttcttttcatcactagactaagtcacaacaattcattttaaagataattaattgttacagtatcatactatcattaaaaaaaaaggaagaatagaatggaagactaaagatagttactaaacaaaaatgtgtcaatggcaagagatacaagagcaaggaaaacatgttaaaagccatggagagtaaatcaaaactgcaaacacaaattgcctaaaataaaattgacaaacatgtaaactcttttcatcaccgaatagggtaatgggtagccaagagagagagataactgaagggtaagaatcagcagaaatcatcagaaaggatatgaaatgttaccaagtcaagtacaggctaccaggggtggatcaagagatgtatgaaaggggggccaaattttttttatacaattatttaaatatttaacttaataaatgattatttaataaattatgaatttcacaaaattatttattatcaatttcatgcgtaaaaccagagatatgattcaatacaaaggaaattaagtaaacactaactcaacattctaaattttctttacttttctctattaatatttttttaaaaagaaaattcttctcacatatacaaagagtcttgagggagggagggagggcaatgcccccccttgaatccgttaccacagggtaatagacacaggttagaaaaaatatcatgagatcaacaaatgaaaacataacatagatcatttgattaattgattaaccaaacaaaaggtttaccgaccaccaaaaaatagccttgggtcagttttgcataaaagatacagcttgccatccttactatcaatcacgaatcatcatcacttataaagttgtgttgttatgtaataaatcactaatcattaccttaattgctcgccaatgatccaaacattctcgatgcacatattttgatgtacctttgcacttacaaggggctatgaaatctctacctgggtaaaaaaaaacaaggaagccaactgaaaaaaaatatgatgacacatccaagcgttgaggataaacattcaacaacgaagcttacatagctgcaatacccaacacgtggaacaataacagtcccaatagcaactatacacataattgcaaaagaaaacgcaattcaaattccaatcaaatgatccagacgttatcgaattattcgaatacaataattcatttactttgcaaccaaaaatcagctgagcttgaccaataaccgtgcttcttaacttaacgcgattcaagttgttataaaatgaattgaataaaccgaacaggtaaaattcgaaatcacgacttattttatttagtatatagaattaagaatagattgttctcaccacatcgaagtgcagcttgccctaacctgaaaagtgaaactgaaaaatttaaaaagaaaaagaggatgaaagtgaaattaccgtcagtttcgagacaaattcggcactggatttgttcggagggaccggcttcgaggtcgatctcggaagggtcagcgaggggaaggggaggaacaagaggagaagaatctgagtgatcggccattgaaattcggagggtacaagtgtcaaaatgaattctaattcttcatcatcatcgttagcttagattaaatttagaatagaggagaagaagaatctttcactgatgatccttctctttctctctctagaactgccaattgcgaattgatttttcaagtttttgttatcacagacacaaaagttgcgagactacagtgaaaccggtgaattcccaaaactaaccgcgaataacaatcaaatctgcgttggataataaaatctaatgaaaaaggttaataaaaattaatattttaacaataattgtaatcattctgatttaatcacattcaaaacaactttttatcaatttcaaaagtaaattatataagaattgaatttatttttttaaaaaaaaaattagcgtatattatttagttatatatctaaacattctaacaaattaaccttccgttaattttttaacattttaacaattgttgataaacaaaatttaatttaaaagtattactagcttaattgtagcttttcactcttaattataattttatgaaatttttcattaatttttttttttacttttctgtgcattactacattctgtcttttatttttaaaatttcacgaattttattcatcggtttttgactatttatttgcattagttgactttattaactgctgaggtaaatttcattgaacgacactgatatgctggcgtccaattaaagataaaaatactcgatttttttaaagtaaagaacaaaaggtatgattaagcctttagataatagtaaacgtataggagatagggtttaaattcttaaaaaagactctttcttctcactaccattaaagtaactaaatcattcggtttgcttgatttatagataaaaaaatttatatataatattaatttttattattctaatttaaaaaataaaaatttatataaatattaataaaacaaaaataataaaaataatgtcacaattagacatagaagttgttatggaagttctttattgaagcttcaacttgaattctcattataatctccaatacaaaatactcaattgtcctaataaaaattttaaacaacttttagattaagagaaattgagaaaatttactaaaaaaaactgataaaaataactaaaaataagtagtattttttaagtaaaaaaaaaaacttaaattaacatttggatcactaaaattatcaataactaaggtgaaacaaataaaaatacatcaaaaatattacattgatatgtgtatggtcaaaataatttgtttttctaatcacgatattggcatgaaataattcttataaaaaataatgattaatctttgttggaaaggcaataaatacatataagataagaaaaaaatttaatataatttatttcatacccaaaatcataattattttattatatagtaaatatacacccatagacaataagtacccaaaaataaaagtagacataggcaataagtaaatttaaaaagccagtactccacgagtttttttttttgttttttttaccggaaaaccgaaccaaaatatcccccaaactaaactacaaatattatcggttagtaaaactgtaaacgtgccaagattgtatctttttggtagtttttgtagcatttacttccaaggaatgaagaaaagattattcgtagagattttgggcttcggccatcaattcaagtttttgggctcattaccagtccatttatcatacctttccaaggagggaacaattattgttattgacactatgctaatagcaattttatcattctacattcctttctttttcctacatcctcaacccttcttccttcctctctcactttccccttcttatttcataatacaccctacccttctcccttcctctctcacttcttatttcttcattactttttccaactcttgtcttcactctcgtctccctcacatcacctaatgttgtatttttttttaatacaacagaatcgtgtttttgttgtgttttttacacaatgaaaacatgcatgatttgctttttttttattttttagaattgtaaattttttaattgttctaaaatatacatattgtatagcaagtcatttaatgaggtccttaacaagtgaataatgagacaaaacataacaatggaaattatttttcgacaaaaaaattataaaacagaaacatgtttctatcgtgcatgtatataatagaaacatgtttccattttatgaagtgcatcagataaaaatataacaacaaaaacatattttcattgtacattaatagttatacaatggacgcatgttttcatagcgcaattgggggtggcaaataaaaaaacacaacataaacatgtttacattgtgtaactatcaatatacaatgaaagtatgttaccattatgcatatggggataaaaaaatttaacaacgaaatcataattccattgttaaattttttttaatcccatttgcaaaacaaaaccatgtttctattttggtttatgtcagggggcaattttgggataccataaaaaggtactcacactggtagtgccaataacaaaagtaggcagtgataatagcaattccctttaaaagaaagcatggatgtgatggaactctatttagtattggggctgctattctcacccgcaattttgcaaaattacttgcctgcccctcctccctttcctgcaccccaccatctttccttcttccttggttgcacttgaatctgcgattaggtaggttttttttttcttcatacttttaactgaactgagttataattttgttgtatttccaacacaacagaatcatagaattttttatttataaaaaaacaacaaaattataattctgttagcgtgtgtctgggttgagatagtaacttaattcgagagattattattcacgcttatcgtgatatgatgccatcacgtcatatatcattcaaacttatatcacgtcgtcattattgttttcaattaatcatgtgccaataatgctcaatttaaaatttatttatttaacgtaaaaaaatggcaaaaaataattatacacagaaagaaaattaagttactctaagataatctattgataacattactacttttaataattatttttcaatattaattttattattttaaccattaaattaaggtttaaatatttttttagttcttattatttaatgttttttttagtcttaaaaaattatatttattttatttttagtacttataatattttaaataatattttgaacagtaaaaaaatattataaaatatcatatgaatcaaaaataaaataaacataattaataaggactaaaaataaaaaaaaaatataataataaaaagaaaaaaagtactaaattacagcactaaagaaatattaaatcttaaattaaagttgggttgaaaattcattaaattaaagttaatttttagcaaataaaatatacatttttatttaaaactaaatttatttaatacttcatttgaccaatttaatataatataatttaaagtatgtttctcttcattataaaattagaaaagtttgatttttgacccaacgaaacttgttgtatgttttcaattcttctaaaattaaaatcttataatatgtttcaaagttaaggttgattaaaattgaacatatatgtttaatgaatataagttcaattttacacgtatttagtccttaagtggagattcatggtatatgtatgtgcattttaaataattgaccttaactctagatcaaattatgatatattttaattttacaaggattaaaaacataaaaaaatagtatggacaaaaatcaaactcttttaattttataaagatgaaaaatatattttactttataatatgtatatatatatatatataatagtttttttaagaaaagtataataaatattaactataagtttttataattattaagctaatgttaatatattcaagaattcaaataattaatattttacatatattggctaaaaaaaattacatatataattgattgcatagttaaaatgagtaattgatccaaaaccgatcaaaacctttgattataaaggggaaaaaaaaccttgttgatgttgatagggaaacttctcagttctcattgtcaatcagaacttgcaagttgcatttccacaaactgagttgataatttttgctttcaactttaatccggccagtttcgtgaccgtgtttgaggagcacagcaacaccaaacatacttgcctttgaggtctttaccctcaagccaatgatagtaactccaaagtcaaaaagttcagtattttttttttttttcattttttcgtcagcttgaatgacacttggatttagacaaaggttttttcataataattataataataataattttcacgtaaggttgagcataggacgagttaattcaaacaattttatgtcattatttgacctgaaattttaataaacctatttatttgagtcaaaaccatccaactacttgccttgcaccccaataaaaatgagaaaaaaaatttactaagaaaaaggtgaggaaaaagtatcagaaatcataattaaataacaaaaaaaagtatattaacaaaaaaagtataagaattttatccttgaggtttgaatattttttctaggtgttttcatactttcaaatcatcttgtaagaatctttgcatgacttcaggttaaaataatatagtattaataaaaaaaagtataagaattttatcctttttgaaacaattaacttgatccaacttaaattaattgaagtataaaatacttttaaatacggttcatcttttatttaaagtaaaagataacgtataagactcaacgtgttgtcaactaaccaatgtttttttcttttacaaaataaaatgttcaagttatcgtatcatatcaaatcaggaaagataaaaggctcacaatggattaacataaaaagaaggggacaagagataaggtggggttgtattgaaacccttgcgcatgtgagaaattacccattgaggcaaccatataatcagtaagtgaactgttatttatggagaaaaaaagtagagtaattgcttatagtgtcttaatatttcgaaacgtgtcatgtagagtaattgttataaatttttataattaaaaaaaatgttttattggttataaaaccaaacaaaaaatgattccattaaactgtattattatttttgtattagataaatgattattctccctaaaaacattaaatgctctttattaatattttttcatttaaaataaataaataatctcaacaagttatagttattctaattaatttaccaataaatcaaatgaaattatatagatattttaatatttatccaattataaatataattatttttttatagatcacaattattttttcaccctttgagtattcgatatacagttacatactcgagatttgaattagaaattactaattaagttaaactaattttgatgtagttgatttatgcactcgattgtacaaatataattgtttttaaatattgtgcaaatgggttttggggatttcacttacttaatatgatttagaaacattattattattatttctgtaaaaaaaaagaaatattattattattacaatttcttcatccttcttatatacttttttaaaaacgaaaaaaaaaaatattgagtttcgtttatgattaagaaaaatgtttcataattaaaaattaaaaactagtgtctgcatcatcacattactaaactaggttgcctgatgtcactactgataaaatcaaaggaagattcactgacgcaagaggaagtcatcatagaagcagctataaaaacacattttagtttccagcatgcaaaacttttgattacgcgagacatatctccatttataagtgtcttgaacaaattatgaaagtagttagcaacttagcatcctcttcttctttttttctttcttaatatgcaatgttgatgtcccttactttcctttttcttgtttttcaaaatacacaacttggggttgctactgtttgggaagctagagggagtttggcaggaaaaaatattttaatttttcagaaacttggaaaacttaaatagtatttgatttgagtgtcttttttgttttcattttcaaagaaaacataaaataacatgttttgtttaaaatttagaaaatattttcaaaaacatgaccaattgaagacaataaattagtgctttcagtttttcctgaaggggtgaaaatatgatggtatcttggaatatataaaattaaaaaataaacattcaaatcaaatgttatcttaattttctgtttggtatgtattttttaaaaataacattcttgagaaatgatatttctaaaaaaaaatttaataaattttccataaaaactttttcgtgaaaagaggaggtaattttactttttttattttaatttttactacagtaaatatatcatatttttttattaaattatataatatgataaataattaaaataatcgataaaaatatacataattatttaattttaaaaaaaattatttaaaaattttgaatggtcagaaaaaaaattatttattaacatgaaatatgagcatgaagattcattatttccaaaattaaaaaaaaaaaaaaaactcctacaataccaatcgtcggttaaattcttccatagcttgagaggccccaatagccattcttagtgacaacccactttggattgtcatttggaataaaaccagcaataggaaaagccaattgggtgtgtttgcttgacgtatcacttgccattattaattattcaaaccaacacaaaatagggaatatgaaaaagaaaatcactcttgtgtcaaccgaccattccaaatgcacccaccaccatcattgtagctttatacacatcattgacaccgagacctaatagcctgtaattatttaaacttatccaatctttttttaaaactatttcttaaatgtcttctttcctcaagcacataatccaatccatatccaattttatctattgcttatcgttttggccttttttcttttacaattacaacaatttcgccttttttcttattagccttacgcagttggtgacgccattgtaccttgcaatcgcacgaggtgaaggtgtcccaatgtccctcacaagtacaatggtcgccccttatgcttcattcgttgtctgtgccttttccgatacacgtatggttccttcctagcaaatattttatggattaaataaaggataatgttcttgtaactaagtcgaatctaaggtttaacaaatttaatccaataacatttaattgagataatcataatttgtcttttcagttatatttttgggattcttatgaatatgatctcctctttaattttataatgattgtctttatttttatctctcaattaatccttaatatgagtgttttataatgacttttgaacgattttatagtttcggaaaatattatatacaaaaataatttatcattattaataaggaattgattaaaattggttgacagagattaaatcatgggagaaaaatcttaaaagagttgacaaaaaaataatgcaaaacatagtccttcagtcttagtgcacaatgagatttgaagtcatgtaacgatcaacaaataacaagaataatataatcaatcatgtaaaataataataataataatagaaatcaagaacaagtatgtccaaaaaatttagggagggtaatcgaagattcctgactcaatgtaggccatattgtctaaagagtgcttccaaatttccattgaaattaaagctcctttttaggcacctagacctcctaaagggtagtgtaggtggctcggatcttcactccaccttgttaaattttctttgtgggatctcaacgtacacattcaaagtgattgacaagttttttcttccagaattttagtaattgtcaaaacaatattgttggtctgataggtcctcaaataaatggaccagagaaatttttatttgaatcataataggtaaatttaaaataatctattaatttatttagtatctgttaaaaaattattaaaaaagtttaatctatccataatttatttcataaaaaatataatccattcattagcattttttacggatatatattcagcatatccataattttattttaaaaaattaaatattatttgtataaattttttgtttaattcactttaaagaagccattatttatttattttttaagataattttttaaaaataaatatttatttcttaaatttaatatattttcattaatatataagaagatattgtatttttttaaaaaaaaggaatccaaatatgaaaaaatatgttggatagctttttatctgtaaatagcttattagatggtccatgagatttgaaaataaaagagtataaattgttattcatcctttcaattatatgaaccattcaataatgaaggctacgttgggagagttaatcataacttctaccatgggaatgtttttcttgtttgcaagatatcatggttttaaaatcataacttaaagtgtaagaaattaaaagagtctaagtgagaagaaaaatgtaggaagaaatagattacaataatatggataagtttaatttggattagaaaagtaagggagaaagagactgcataaatgtaaaagatttaagtttggagaaaaaaaatagggagaaagaaaccacaaaaatgtaaaaagatttgagtttagaaaagaagatattggaaaaatgtaaatggttggaaaataaagtgttaaaatcgcaaatacaagaatgtaaaagacattaatgataaaaaaaataattaaagtattgaaataacaaaaaaattaattaacaaactaacaattaatatttatcaataaaaatattaaaataaaaatgttaaaattgaaaaaaattaattattatgtagtgacaatataaaataatttctcactgtcatacaatcataattcatgatttgtatgactttaagataattttgttaaaattaataaacttatgataaataataatctataattggataataatataaaattattttaaatagttattgcataatttttttttacaattaatatggttgaaaacattgtaacaacctgtcaatatgagaacattagaaacttaggatatgtaagatatttacaattcacaatccttattacatgatgcaaactagtatttttagacagctattcctaactataaataacactatagacttatttcaataactttcaaactcggtccaatcagtaattcgatttaagtagtgggttactggtccaatgaactagtaattgacttaatatatatcaaaaaatttaaaattatatatgtatttattatatataactatataactaacattatttgattaagaaaaaatcatttatacttcaaaataataattgaagtattaaagttgataacaagtccacaaataataatttaataacacaattacacaagtttcagatttttttagagcatttttgattttttatacacgaaacaggttttaaaaataaaatcggctcgtcgggtttaccccaaatcggtctggtctgaccggatcatccgagaccagatgtatgaccggtccaataactaaatcaatccaatccaaatcgagacaaactggatttttgaaatatggtttgaagtgtatttaaaattttatatacttttttatatctatcatgttatagatataaaatattgataagttttattaataattaattattataaaaaaatgatggtctatcaatcacaattttttttttcatttacagaagttaaacttgagatttaatttaagaaatctaagtttaattttactcaatctaatcacatgttagtaaaattttatacagagtctaataattatagataaattagaattttaaaatatacacaattaattgccaataaaatatctatttttcttctcaagaaaattacgagcatgtttggatatttgttcaaaataggatacacaaatttcaagataaatttaatgattcagaaactttattttgcaaaatgaaggatttgagtactttcgtaaacctcattttagcctaaaagtctgtttgaacaataaaacaaacatttactaccttattattgcctttccttaagtagcaagttattaattcctttattttgcaagtgaatacgtttcatattgcatgttttgacttggactaatggacttctccatattgaccaaactcttaaaaacaatctcgattgtcttcttgcgaaattgatttccatcgatttctctctattttttcttttctaaattatattgacaactatatatatatatatatatatatatatattatgtaacaaattttatgatgcagttagataacaagaatcaaacaataaaaatatataaaaataagcttaagtaattaatatccctaaaattaaatcagataaattaaaatggtttgtatattgcttgattgttgacttgttggaaaaaaatttaaagtgtgattggctctcctatcttgtcactaggaaaaattaagcaacaaagagaacaagtaaaagaaaatgggcaaagaaaaaagtgtgaattgttagttggggaatgttgggctgttcggctagaacagatattgctagaacaaaaaagagtaccaaagtagatttggattccgaagttaggaaagaagggttattttaaagtggcaggtaaatgtaaacttccaataaattaaaggaaagggaaagaaccttactatggaaatgtctcaccgtgacattgtatgtatttggatgaaccttcataaaattaattctaaaagaattgattttataaaattaattttgaagtgagatagtttgtgtttaaatgttttattataaaatcaagttaaaaataaaattcagtacaaaaattttatatcaaaaatagaagttgttgaaagttactttaacaaaaaatcaattatacgtttcaaacataaaattaaacatctatgtatctaaaatcaattttgtattcagaatcaattttccaaagttaaatcaaacatgcactattttttttagacgttattatataaatctatataaccttctgggagtagtttaaacaaatctaatctggaccaaacaaggactcaaattatcttccgggtgtgaagcagtacttcatatcatcaaacaaatgatagacatcgcatttcctttacttttattattagtaagaatttctattggcactttttcccttttcacctctttttaagataaagtttgtaaaagattgttcaaaccaaaatcataatgaaaacttctgtgggtgtgggtctacaatcctgcaaattcacggaagcaacaacatttttatcactttcaactataatatttgcatatataagggcattttcgcattacccaaatttctttccttttttgttgttgttttggttttggtttacgtttggttaatacaagtatagtatacacccgatggatcttgcacaaaaaaataggaagtcatatcccataagaagggaactgaaaaatgtgtgatgatcgtcaaactcgccccaacatcatctgaaaggccaatatgtgacacaaaataggtctgtggtttgtggtgattgctaattaaaatatcaaaccagaagacaaaagggacaaagaatgacatgtagataacaacttagcgagtcagttttgaacccttttgtctcaatggcgctgcatagcgtagcattaattaatgtggattttaatatatcctacacgcaacatcgatcatatagattctaactggtttgggtatctttacatgatttttttgcgaaataagattatgcaaacaaatatagatggagaagtactatatattgtataagaaaatatttatgagggaagtgtaaggatgtttccatgaaaaaaagaagatgtgggcctgacacaaactcttcatttcttatatgattatgtcatttaaaaagaatataaaatatcatattacatttattaacaaatattttaacacatattaaaagtggaaggattggttgagagggtttttcttatttataataagtatcatttttatactaaaatgttcttttttttttttttgcgtgtgctttagtcaagctctctctctctctcaaatttcataaaatttgtgaattagtcaatttcgttttaattattatattgcccttttcaatttcttataaattcattacattgcatgtaatttatgtaaatatttaaatacaataataaacttaattgtataaaaagtaattgtaaatttgtatacttacatgcaaagaatgtattaaataattaatgcgaatttaattagtattagaatgataactggatttgagcgtaatggatacgcaatataattacttatacgtaagctttttatttaatgttataggtacggaactgtagtatagcactcatccagcatctatattagcccctatacacatataataaatataattatagaattaactatttattatatttataattagtttaaaaatattttagatatttttaaataaaataaaacattttacttttaatttttttcagttcataaaaataatttaaatgtaaaaaacatttttattttaataatttataaaaaaaagacacatcgaaaagaaaatatattacatgaataaaatactaataatatgtttggatacatacccatttgagtataatataagtatggatttgttttggaaggctgaatgctaaagttaacattgctttacgcatagatatgaagttagataaatatttttcttgattgcggatattcgaatggatacattacacaaatggctagccttactaatgatttgacatattattattaagcagtaccattttctactacattttaattactgaaagaatgataaatgttgtaagatatcaataaacattgacgtaaaaaaacaatacgcatttaatattatgcttagggtgcacaccatttaactaatctcgttagatacttgcttagtgctttagatgctttgatttattaggcacaaatgcttttggaatttggtatatttatcgtggaggtcaggtcaatggttattaaagtggagagggatgcatcgaatcactagcctagtagcccaatagaagtaatcggcatttcgaaggtctccattaatattccaattccttagcctatcaaacatctaatctaacatagagacgtaaggatctgccaattctgatcataacaatcaacgcaagtattcgatttcaataataataataataataataataataagatgggaatgcataggtacaaatgttcgtattaatttgttaactaataatttaaatggcatgaaaagcaatgcataaaaccagccaaatgttaggctgtgtgtataatgtaagacacgaaaaaaatattgaaatgattaggttttgtccaatctcgtgtgaaggtatgacgtccccttctactctaaacactccacaccaccctcacttaatcatataaaactcataatttcttgactttctaatattgttggtggtgccgtgttagtgcccgcattctatttaagttatcatttgtaagtaatttcgtggatggtgacaccaataataacttatactaacaactaattaagaactatagattaccacaaataattaaataaataaaaacgaccatgaaatattaaatgatggtatgctacattattacacataatatataatactatatgatataaatgtagccttgtcaacatgtgaggtgagtgtgagtgtggtaaatctttagtactatttgattcttacaaataaacaaaatgtaacaatgccggcgttgatatattccggtggcgttgagacagtgaagggaacagtgacagagtcgtggtctacctggtgcgcacattagccatagtggaaacatgacgatgactgcgacacttggtatgtgaaatatatttgactctctgtagctcaacacgaccaagcatttaacaacaaaaaaacaagttccactctccaataacaagacacaaaagtctcctctattctaatacgtttttatttttttatttctatgtatttgtatatacataaataaataatgtaaccccatttacaaatggtgggctacgtttccattttttattatataataaaaattgaagttagaggcagtctttgaaagcgtcgtcttctgaaccaacacaatgatggaatggaagggtcttgcgttcttctgcggtttgatagatagctagccatgttggcatgaagatttgagcgggaaaataataagacaacatacataacgttttctcaaagtggtttttttattttattttttttatcataaggtttggctttttagttttttatttttcagtttttgtggataattctattaactgtcaagggaggaaattggtacagatcaaagtttggttgtactttgccaactaaatattatgacatcaatagatacttagatagatagatgcctttatttatctttgttttgaactactatgattactggtactttcttctggcagttgttacttaaaacttttgttgtctttggaaaaagggaacaaaaaaaggtaaaagggggtgctatttaggatttggttttgtgttcctatgtttgcgaaaaatgatgaggtggttttgttgccctattaatgggaaaatcgtactatagattctgttgcataggcgttgtctgtggcggttgtcatacaaacgtggtcggggtggaggaagaaactaaaacatggtttaattaaatgaattattcgtttattttgtgcttctctttggcttgtgatgtctggtttttttcttgagatttaggttctgtttgtttatcgtggattgttagatattaactaaggaatttcactcttcgtctctctcatagtacttcttctggtgccaagaaggttggaacagtagcaattacttgatctactctgttacctttttctgtctttgcttcttgctcctgccacccttctattcttagtttctctctcttatttttccctttagttgtttctgttattaatttttgaagtgaatgtgtttggcttgcaatcttcaatgcattttaagattgattgagctttaattcatctttttttgggttttgccagacggcagtttgcctgcactgatcagttcttagagcatgaattcagcatccccgcagtttgtttcctcaagaaggatgagtgtgtacgatccgatccaccagattagtatgtggggagaaggcttcaaaagtaatggaaatttaagtgcagccatgcctctaattgatgagacagacatgaagtttgatagtcaggtgcaagtctatgaaatccgtgctttgtttcattggcaaataaaaatgcctattctgcctactaaccaaattcgtttgtgctgtttaatacccagtcagaggatgcttctcatggtatactgggagagcctaataagtatgaccaagaagctaacaaacctactgataaggtaagagcatgttatgcaaactcgtttcctcttgctctatctcttccccaaacaaaagaaaagaaagaaggcttatttcttggtagtgttttgttaattacaacaacatatatttctttaccactgagagcggatgtaaattttgtctcatacccacatggtttctaatactttctgtcagtgggttttccctgacttccattagaaaaaaaaaactatatatacttgggaactcttgaatgcttcctgcaactgaattgtcagctcaacttacctgtaaatgtagatatagataattttgagcattacaatttcttgtttctttcattggggcatttgtctggcatcaaaatgttttttttttcattaaatatgttgtcattttgaagcttcaagtcttattctgtagggtgttgttgtataatgtaacgaagtaatcaatccatttagaattatggacagagttattatttggaatgttttggcatggaaaatcacagccttttcacttttctttcccctccatcttgagctttatgtatacaattagggtgacaatgacaagtatgttagtcctgccattttggactttgaggaatctgtatttaatttggatgtatggcttggattcatactctcttttatgcctatatatggtggaaacaattagggatctaatatggtcaaacatgcagatacaaagacgtcttgcacaaaatcgagaggctgctcgtaagagtcggttgaggaaaaaggtttgaatgaatatacgttgatacattgtcagacatgcaattagtgtttagatatactaatgttcatgtggttgctgatattggcttacaggcctatgtgcagcagttagaatcaagtcgtttgaagttgatgcagttggagcaagagcttgaacgtgcaagacagcaggtatggagaagatgagttaatatactagcagtttctcttgtggatcacattatgttgatcagcatcttccttcctttccctctctctttaatatcttaaggcaacaaaactgcagggaatttatataggcggtgggttggattctaatcatctgggttttgctggatcagtaaattcaggttggtttgttattatgctactgctgctatatatttgcattgcacttggagtttttgtgtcttgttattccatgtcttggtaacttgatgttttcgttttttaaaattttcttctgtggtgaaatcagtttttccaaatgtgcttaaatctcttactattggacatctgaagactaaagtcttctttgtgtctgccatctcaaaatattcagaaacattttctctagtcctgtgccaaccttttggtttcaaatcataatcagttttgtaatagaatccattatttttcttccaaatatccagaaagcggcagaatgtttaaagccttgatatatgccagttggagaattatttatatgtatctttcatgatacccgctgccaagctagattatcaggtctcatacattaaaattgctattccttttctttgttggatgttgtacaaaaccataattaaactgttggtaagttgagaaaatattgtgtaccataaacatatcttgatagtgtcttatattagcccccagaaacaacttttgggaatcttattggcaacacaagtattgaattgtttagaatttttcatggtgccatgtaagcttaagttagtttgttttgattgatgtaatattgttcttggttttccatgagtatcttttcttcttgtgttatactctattttccaatttgttcttgcattataataataccatatttgcaggaattacaacctttgagatggagtatggacattgggtgaatgagcaaaatagacaaatcacagaactgagaaatgctttaaatgctcatattggtgacgtagagctcaggattttagtagatggtatgatgagccactatgccgaaatgtttcgcatgaaatctgctgctgcaaaagcagatgtcttctatgttatgtccggcatgtggaaaacaacagctgaaagatttttcctatggattggaggctttcgcccctctgagcttctaaaggtgatgcctcatatttaataaacgaaagtagttaaaaatgttattcatagaaatgtagaatgtgtagatctaaattcagtcattgtctttgaggactttctcattattattggattttaatcaataacttcttctactgtcttcttgagagagagagatgggggaaatttgaaactgcattcatttattacagttttaatacattatgcaagatttactcaaatgctttttgtacttaaaatggctatcactcagtgtcagtgatagtcccagagagctgggtccagcaagaggtgatattttagatttagtcttgacttcttgctttggtaaagaattgcatcctcacacctgaatttcaaattttaaaaaagggatttattgagatactagattaatttgagattatttctattgccatattcaactatggcatgctgtacgcttgtaatgtagtatggtgcttgctgacaactttattttaagtgcaggttcttggccccctgattgaacccctgacggagcaacaacgtttggatatctataaccttggacaatcatgtcaacaagcagaagatgccctttcacaaggtatggacaaactccggcaaacacttgctgatagtgtagcagctgggcagttcatggaaggaacatatattccacagatgacttctgcaatggacaagttgaaagctctggtgagctttgtgaaccaggtagatatcctgttttcttgatagacattagttctcaatttagtaaaaaattccttttcacaacttgccatatcaatcaatggattcctcctgccagttgcaatttttatccagatgttctgtgaaaaaaaatcatgtatgtgttctggtaaatatactttctaatccacatgtgcttatttgtgtgtctgtctctctgtctctactcactatagattcaaaatagaaaagcaacagtttagtgtgctttaaatatcatgattctatgtcatatgaaataggaacagatgtttggttattttaaatgtatagttttttgggttaagggtattgttgaagttatttgaagctattgatcttgtaagtcaacaaatttttcatatctaaagtagttcttatacatcattctataaattgttttgtagtgcaattgattttaaatttactttttggatgtgtaaaacccataatttgatttgaagtagatgaaaaatatttcataaaataaattccattcctaaattcttagcacagatactgaaactgaaatatttttcattctaaagaatcctcagtagaaatggaaaacaacaatttaatcaatcaattcaaagttttaaaacataattagtggtttatgatctattttaagcatcctcttacgatttgggggcaagtcattgccgtaggcatttaatttcatctattatattagctgtgacttgtggttcacttcaaaacctttacccattcatcttggtcactgatagtgcttgctagccagatttttatttagcgttaccaacttcccatttagcatttaggtagattcacttaggatgcctatatcgtgtaaatgctaaggtcataaagtacagtgatggttaatgaatgatacattaacagaatcatttttgaagatcattaactgctatatacactacaaatttacaacttcaaaaagttatagcttggctaatgactattagagatttaaccatgctctgtgtgaaacaggctgatcatcttcggcaggaaactttgcagcaaatgtctcgaatacttacaatccgtcaggcagctcgatgcttgcttgctttgggggaatatttccaacgcctgagggctttgagctcactgtggtctaatagacctcgtgaacctgcttagtctcacaacaaggttacaagagcgcaaactcataacatgaacgtgatgtgatgatgaatatgggtcagtttctttggccaagagcatcaaaaccatgtatcatgtgaggtccaggttgctcacatttttcctgcagttttgcgttatggagaagttgtaaatatgactgctagctcattttatgcatacgagtttgtaaataaattaattttagacgcatggtgtatatcggattgttgcaaaaatgaaatatttagaatctgccatgagtctgtgtggaagttggttgtgtagaattcgtataatgttatgttgtgtgtttttgaaaatgaatcgactctagactctcttagtggacataatttattttttgtgattgctaagggtagcttgttaaaaatctgtaagttgttattagtttgttagaaagttgttaactctaataagctctataaatagagcattcgtagtcttattgtatcttttattcaatcaactgcaacatgattttatatgatactcttcttctctactctgatctttatggtgtatggccacaatatgttggtgttacttgtctctttcctcgaagttctgatagtgatagtgctcaacaatatttatcataaatttcatttttcttggatggatacttgagattctgtcctagatgctgagtgagaaaatattaatgtgctgaaggttttacgttttcatttgcttttctatatatatacttatattggtaaaccaaacatacacaccaatccacttattcacattcaatttatattgtcaattgtttacaggattttcactatgcaatgggatgtgcagctatcaggatttgtttccttatagcaaattggtttgatgatccacttgtagctagcaggatatataatcatcttgattccagacagaatctcacaacttagatatagcacagtccaaagcatctacaaaaaatctgcacatcaggaagccagtcagtgaacttcaacaaagaatctgaactccacaacttggttgaagagagccaggacagaattatttatatacctgcatcatctttggtgaaacacattggtggcttgatcctaaaaacatttccatgcagccctcctttcccaactagaataccgagctctaaaatttataggagtaaacagttaccatgttttgtagaaattttggaaaagaaagcttcatatgcaattttttttattcaaccaaatttcttaccgctgaatctttcatgcaaagctgttgtttcagcttttgcaggtggcttctattttctatcggtgacaaattctatccccaccattaagcctcttcctcttacatctccaatgactggccaaatatataaaaataatcaacaaattgtggcaaatgtatgctctctataatgaagcatcatatagatacctaagaaaaggcaaatgtatcgtaaaataaaaatatatcacaaaatgaaaacatgaatatttctgggatataagattcaagataaccatactgtcatgtacttgcatcatagatcttaaacgctgaatcgagtgagaaccaacatcagcacaatgacattgacgcctctccttgtcaagaactctgagcacagcaagtcccccagcaaaacatacagggttctctccaaaagtattaaattgaagcttctgggccatcacgcttgctatttctggagttgtaactacagctgctaatggcaaaccattgccaataccctgatgcatgttaacatgaggtacaaatcatacaatggaattctagaaaaggtacatgagaggcacttcaacaaaattggccctatctgaaggtaatgctagaacaaaatacatagtatagtgaaggaaggcaaacaaaaaaaaggaagctaaaaccgataaaaggataaacattgaagttatgcttaagagttatacagtgagagtgcaacaagtgagaagaattcatttaatattcaactatataatgtttaagattgctttacttaaacctatatttataattgtatcatcaaattagttcatctaatgggaacatgctctcatcgtacatgcttcctatatgcataaataataatgaacctcacaacagactgatgctgcacttcaagtgcattattaaggtgccattgtatcctgcaactagttaaaacttagaaagaagagatgagggtctagacctttgccatggtaactatatcaggaatgacaccctgtgtctcaaatccccaaaaatggcttcctgtgcgcgcaaacccacattgcacttcatcagctatgcagactcctccagctttgtgtataatgtcataggctagtttaaggtacccgggtgccagttcaactgctcctcctgtccctagaagaagccatgacatgaggaaaaagtacaaaggaaaaccacactatggtgtggctataaatattaaataccactctgaagtttagaaattaaacatgaaggatggattatgcatgcctgaatagtttcagccataaatccagcaactcttcctgaagggccatagtcaatatgatcttgcaattctctggcgtacctattggcatctgagccaaaaactccgcggtatggatcaggattcatgacatgatgaacttctcccttaaagagttaaatgttgtaaaaaaaaaatacaattagcacttccctatctttagtaaaaagttaattcatcgttcacaatgatatcgttacaactagagtagcatggattatgttacaatgatatagtacatgtttgtgtatgtttttggatacatatatgcacgtgtttgtgtgtgtggacaaaacctctggtattgggtatttctacgtgttcatagccgtgcgtccaattgtactagaactctctccatgatatgcattccttaaggaaatcatacccatattaccagtgtataaacgggccatcagcatcgccaagtcatttgcctctgaaccagaatttaaaaaataaacaacctgtaatataaattgcttagttgaacaccatgttccatattgaatgaatgaaatctagcacactataaaactgaacattgcttttcagcaatctcaaatttggcatgtcacagttttacacactgtcatataatcacaaattgattatttgaattattctaaaataattattttaaaagtcaacaaacttaccatatatgatgaattatgattgaatgtctaagtaaaattttttagtgttagtgtttaacctatttctcttacattatttatcattcttcatagcattaaattggcagagggtttattaaaatttgtaaatatttatgtaaagagaaatagatataaaatattacaaaattttcatgggactagatcatgtgaaaaattaatgtaggaggatcattcccttgtttggatatgctaactgaaacacaaattatgatgataaaattgaccttaaggtttccaggcattttggatgccaaggcctcggcaaaatcagctattgcatggtgtagatatatggttgttgtatgctgcaagagtttactttgctccattatagcattcaaaactgcaggatggcaatgtccacaagaaatagtaactattccagcaaaagcatcaagataacgcctgccattctcatcaaatagatgttgcatcatgccctctacaatgttaagctatataaacaaaaaaaattgttaaaaattacaaaaatatgtggcactcttttcatatttaataaattttatttataattttgtaattctcaataaattttaatggagtgtcagacaaaatatattaaagaagatgtgagctataactcctccttacttatcggtatcgatgatgggattaacatatgacagttcttgtggagacccattttcaaataacgtaactatttttacttcatttctttgactcaattttcagagaaaataaaactaagaaaacatagagaaaaggttagcaacttatcataatatagtaactgataaaagattgattaatttgggagactcacaagtttttgatagaagtggaacaaggaaggaccaaggaactttttccgtttggcaaaaacttcatcagccaaaggtcctttgtatggtcgtggcttgtaatcaaatggtggaagctgaagcctccgagcaatatcatgatcacttgttgcagttgaagtgctcaaacaagaagaagaaccaaaaagcctcttacaaacaccaatgcttctcttcaccatcgccatgtctaaaccaccttttactaaacactacctatacctttatctcaaactcgatcatccattttgtaatgctttgcatgccatgtctcacgaataattgacatggaatcttgttaatttggattatctaacattcaaaatatattatgcggtaattcattttattcaagtaatgtaataaatgataatataaagtttaatttttcaagtcatctattagatatatattgctttccatgattgagctagagcaaaaaagaaaaaagtagactgaataatgtggttttattgccttttattccccacttgtttgcttggtgtaattacaccgtccatcatcgcattttataatgaaaagaacttaaatacgatagtatatgatcatatatatcatataatgagtataagtgcaattgaaattgatcgcccaactacaaccatcgtcctgatcatggcagacatataaatgtacatcgattgagtcaccaagagataaatcctcttttattttgattgagtttataggaattaatcatttattacttctatttgtgtaatacccactccagtataaagtaattcagaccttcatcatttttcatgtaatttgattggtgtaggaagctttcaagggaagaagagagagcaaagtgatggaattaactactggaataggaaagtgtgtacatcaagcaagctatgcacgtacagcaaaactacatgaaaacaagaggggtagttgtagagacttgagataaccagaagaaaattgtgtagatttttcattcccattatttaatttcaatacaattagcatttagcagtacgagaatcatgtaaaggaaaacttgaatagacgagaacaagcagggtagtagttgtacttgtagatacttgagataaccagaagccaaattgtgtagattttttatccccattaataaaatacagcaagcagtataagaatcatgcaaaggagaaaacttgcatagatgagatgaagatatcacaacatcaatgaattatctcaaaagcctgcaggaaaaccaccctttcttgggtcactcactgccacaagctttccatttccaatccctttattttgtctggacggcacagaattgtctagaacaataaattggcaaatagtcccaccggcaaggccctttaggacatgacccttacttttaagggcttccctgatatcagcaggaagttcaaagtgttcacctaaagtggtccaattctcataattaaccacgttaggtagtagctgcataaaacaacatggcgagtttctaaattaattagtgatggacaagttgagataagtatgcagtcacaatcacaaaagagaaaaatatcagaataacagtagcaacataaagacaaaattcttattacttaaaatgaaccaggagaaacagtttctggggacaaaaatatggattcaagttagaagttttaaattctgataagttataacatttttccttggttttaatgctgtcattcattatatatctataactgtctctgtgtttggaagtatttattacagtttatcttgtgacataagtatttgtgcaagtatttgggaaaacttatcaaaatagcgtatgattttgtctataagttgtttttagcttaattcaatttgttctctagtataatttatgaaaacaatttacaacttgtgaaaacagtttaatcatatttcctcttgaattatagaaacaacttatacataatcacttaaatggcaaacacttgttcaataagcacataattaagttgtttattagtttgtgcataccagagcttaccaatcagaggcagaaaaaacaagcaaccccccaaaaaatttaaatacaatacctgatgatagacccttggagctgttacagaagaaaaaggatccattcctttaacgaagtgattcaaaagaacttctgcagttccaccaatgatgaaagcacctccacttgcacctactacagcttttagcttcccatcctgtataggcatggtaggaaatcattgcaagtaaagaatatgagtaccttgaattaataatagtgaaaggatttcataaccattgcaatcaagatttgttcttttgtatgcttgacaagagtgattgtgtcatttaataaaggttaaattactcagttggtccctagaatatctgaacattttcaagtaggtctctaaactatttgttttttaattaagtccctaaactaaaatttggatccttggattattttatggcagcttgaaatggccagaaaatgataatttatgacggttttaaaaccctagtgactcacttaaaaaatcaaatgatcaagaacccaattaataaattttagtttaaagacctacttgaaatttctcaaatagttcagggaccaattgactaatttcaccttttcttaataaattaaaattcttatatctctatctcttgatgaagctcaacttgagcagtagtgggtgacatggatgataatgtggaagaggatagccacatttaagaaagtcaaatcttgataaaggattgattaccttaagggcaatagtgggtgacatggatgatagtggccgctttcctggcatgatgaaattggcaggagctggtggtggaacatccttggtaacatttctaggcatggaaaaatcatccatttcattgttcagtactattcctgtacttggtgaaaggatctttgaaccaaaatatgcattcacagtgctagtcatggaaatggcatttctctcaggatctattatacttaaatgacttgtaccatgatcatggatctgattccacctgaaaacacaattcagcacaactgagaattctgtattgccacaaacttaattttagtttagaacttatttttacttagatctttatatatatatatatatacaacttagcgcccatacatacaatcattttaaacttccttcttatcatctgttgtcatgttaacacagagtaacacagaatgtaatgtgaggctgctactatacgctggtttgtgaagattgaattcattacttcacttgacggttaaatgacattggtaggtctaactgaataagcctagacaatagatagttattctgttgtaaacagtacatagctgcatcacctctcagtttctgttagtttagccaaatgcatgtatataggacaaatatatatatatatatattagctaaattgaaatcagggctacatttaaggacaaatatatatatatatatatatatatatatatatatatatatatagatagatagatagatagatagatagatagatagatagatagatagacatgtacagcataatcaagttgaccaaatgcctagaacacctaaagtcaacctttatatacaagttgcagacacttcctcaatcaagatatatctttctatgtttcaagttgactatatcatgaaaccaattggtcaagaaattgatatctttcaactctagcttatggagatgcgcaagttatgatgcattaattgtcaatattttctgcattttattcttgtcattcacaccaaaagctgcatattgcaagtgtgtgaggtagaagacaaacatggaatctaaagaacctcattaacttgcacaggcatgaagctacgtgaaaattagtgtaaactcaaagaacttaggagcttacctgctgccgtaatgactggggccaaaagttttattatcatttatgtcatttttcaacacgttagcaaacctatgagaaagcatatcagaaagaaccccagttatatttacaaaatcagggtcaccaagattcattctcacggcaaatacatgcttcaaagcttcaatttctcgatggaaaccaagggcaccagaaaggccagaagggagtttatattgatctagaatgttcagcagctgtaacaaaagacagcattggctaaatcccttaatttgctaattataagatagatataaagaagaaaaaaaattattaacaagaacacaaaggtagtgaatcagatagacttactagcatcattggatgcccacctgaagggggaggcatgccaaggagctttagaccaagaacatcattagatatgggttccttctgtttaacagtgtaacttttgaggtctttcatgctcaatatccctccagcattctggacatctttaactaaattaagaccaatcaatccttcataaaaggcttttggaccagactctgatattgttctgagagtcttggctagtttcttattgtagcaaatgccacctatctttaagagttttccatttggggcaaatatgctacgaagacccttgtcttccaatatatctgactctgtttcttccatctgcttgtggaggtatggtgatactttaaaccctctacgtgctagaatctcagctggctttacaagtcttttccatggaagcttcccatgttgtttccacgcctcatgaaggccagcaagttctccaggaactgctacagataggccacctttggccttcaaagtagtatttccagcatacatatcctgaaaaaaatggataaatcatgtttaatacaccttatcaattgtttataattactttaaaaaaattaagtactacatactttttatggtttaaaatttagttttgttaacatgggtgctgattctaaacatccaaaagtaacaggattttattaagaaagaaaacatttatcacacttatgtttctaatgcaatacaaactgtctttcctaataaaattagtctcagaaactattcctcgagataaaaagattgatttaaggggttcacatcttccaatatgtgttctagcatacacaaagatcgtaggatcaaactcctaaccacataatcaaggggtatggttatttaccaaccatgttggttaaacattttctttttaatacaacaagtacttatttacttctgcattaatttcctgttttattttatgtttttacttttaatttataaaactataacattattttaaatccattttctgttttcaaatgtttgtacagaaaaaagaaaaaaagttgttttcatggttcccttccttaaaaatctctgaaacaagaacccaatttaaaacaatgtatcagttttgtaaactaaaagtgaaagcagaaaatgaaaacacagaaataaacatgcccttgtatttttatcatatactttttattttatttctttaatcattgagtgtctaaagataccattagtctttgtgttgaaaatatcaatgcaaggatatgtgatgatgaaagaaaatgaaataaacaaggagcaaaattttcagttatttttggttttctctctttttcacttgagtctcgatcatacaacaaatttatcaattgaaactacagtaagcagaggaataatccataattgaaaaggaattaatgattcagatggttaaagagttaaaagggtaccttggaggcaagagcaggagcagtttctctcatatcaaaagcctttgccaccccattattcaacctgagaagcaaaaaggctccaccaccaaggccacttgaagcaggactcacaacccccaaacaaagggaagaagccactgctgcatccactgcatgccctccttctctaagaacatccttcccaatccttgagcatctacggtcatcagtggcaacagctccattgtgggcatagatcacctcacctttgtgttttgggtgtccatttgtttcctcaaggcttgaagcaaaggccaaatttgaaaccaaaagcacagcaatgacatgccacaataacacagatacaacaacacttgacatgtatggggacagaatttggtgtagggaatgaaacatttgctgctgacctgttgacttttgaagccgagacatggatggaacttgcttcagttcagtttgctgtaataacataaagcaaaagaatggatggcacttggcagtgtcaaaagtggaaaggactaaggcaacctcggttcttatgttacttttgctttttaagcactgatgtctataagatcctgctattaataggggtatttgtaccttaagtggaagggtttgcctgtgttctgatccggtttaaaattttaataaggtcaattttgactcgacagatatagaatagataagattaggtgaatctgatttattgatataatgtatattaatgttacatataattaaatggtagtattaaaaaagtatactaattatgttatgttttataacatattttaatataaataatattaacataaatatcataatattatgttagaaaaaatattactttttctctcccaaaattaatgttgtattttaaaaaaattatcccaaaataaatgtcatgttaatttattcaatgtagaactaattattttttctagtaatacctctattaaatttctttttaatttttcaatgtaatactaatattatttcctttcatttatttaattggctaattttgttaaattactatttttttattttttttatttttttattagttgttatctaaaacaacactttgagataaaaaaaaaagtatttattaagttaagagtatgtattattaatagaaattatttaagaaatatactttttaaaataaaaatgtataggactatgcaaaatataatatgaattcaagcctggtcaaatcaattgaacgggttacaccaggaacactctcacttattaagcatcccttaaaaagtaagtgtttatttaagacatgtttaagttacttaataaattggcctccaacttacatttccaaagatctccttttgtaacttatacgttgaacttgcattggaatgttcgttaccacactttcaatgatcatgcgcttatacgttgataatgcatcggaatgaacgctaacaaacttctaacgatgaaacaaacatgcacttaagcatcttgttcttaagttttttaacccaattaatatttaaaaactaaaaaaattaatgttacataaattttaagaatgtagggttatttatgagattcgttcagaaatattgtattagaaaaaattgtttaaatcatataagataaaaattagtgatgcataatgataccatccacttaaaatatgcaaagtaaaatgctaaaacaaagatactccaatcatgtgatatgattctttgtaatttaaaaaatattctttgtaattgtaagtaatctctcacgtacctataaaggttttagaaactacaagtttacgattatttttgtctatttaaaatttgtattaataattaataatcaagtttgagtgagaaaaaaataaatatggaacgtctgaataaatagcgtcaaaagacaaagtgctgaagtagcacgagggaattctgaagagttaaggaccactccaccaatcatgttaatggttgagagatgctataggaccgaactcagcctcaaccattcaaatgatgacagttctcaatgaatttcttatttaattaaacattttacatggcacccaagggttgttcaaaaattaaacaaaatcatttataaatcgtcaaattaatctaaaaaaattgcaattggcttaaattgaaaattacaaaaattgaaaattgcatattttttaccgtttagttcgcttttcaaattttgttaaaaaaaaatcaaaccaaaccaccagcgtattataattatattaatttttattgtgataattaataataagtataaaataattatgtactttttagttgctttataatcaaaatatatattttactttcaaatgttaaaaggaatttaccaatattatgaggtagaagacagccagttggacataagcaataaaaagataaataaaacttaactaaaaatcatttttatcaaatatccaattcatcatatattattcaattatataatatttgattgtgaataactcatctttcaaattgcaaaccaagtcatacgcggacaaattaattgctagagcatttgagtggctgctttaagtcaaattatggcaaacatactggaaggtcaacacgcaactgcagtcaacgtgtctgttttaattttttcttcttctaaaaaatacattaaacctgatttttagaactcgtttaggtcaaatggctttgggttcgtcaagttatgatcagattgtatgttgttaagtctttactcttcttaaatagactttttcaggcataaaacagttatttaaaagacaaattataaccctctcaagtctcaaacttttgacaattttttttttttcattttgttacaagcaaactattaatcttttgaaaataaaagttgacctgggaagtggttgcacacagcatctaggaaaaaagtcaaaaagcaacgctggattagaacaaaatataattattgtttatttttctttctttctttctttttcattttttaatgacatctttttccattgttgtaatggcagaaatcagtgttcagtgattgatgatggtcccgatctgatcaaagattcaaagacaatccttttgctcacgttgtgagttgttttataaattggacaatcaaaattgcatgacaaaatttacaaactacaatgttctcagatgtcacgtgaaatagatgatgcacagtactactttaattatagtagtgttcaaaaatgagaaattttaagattattcaaaaatcttgaaatattttaaattgaaattaaatttaattaaatctctttgattttttaaatattctgtttagatagagagaatttcgatgtcagtattgttatccaaagactatttgacaacgaaatcgacaaaagaaagagagaaaggagagagatgggaagagcatagagagaaaatagagataggactaaggagaaaaaataagtaagaagaatttcaaattcttgctttttgactttttagtgtaaaaattgaaatattttattttaaatagttaaagcatttcaagaaattaatataatttcaaatactttttaaatacattattcaaataacttattagttttttttctcggagacttgagaattttagtgtacttttaaatctgatttttttttaaatagcggaaatcaggtttaaaagagtctacggataattagtatgaatacaaagattgggcctgagctcgaattaagcccagattacctggggaaaacaacagataaatttacatgaataattttttttttctaatttgtctgatttctttctgtaaaaatattaaatgcgttttatatttttaagacattaaacgtatttatttttatttaacatttttataaaatagtagaaagttttattaagagaatatatcagtactcaattcacataatgtcattgtccaaattccaaatatctggacgcattaaagtgaagttacctgttgattgatcatgatctacttatcttggatgtactataaaagcccaatatggatacacatagaagctagcccaaactgttcaatcctatcactgacccgtttaaaacaaaatggatgagttgaccagttttggaaaagtgggtggttaaaaatctcaattggtctcattcaaatgtgggttgatttgaaaaaaaacaaaataattatgaaaatgtgctaaaaaaaccaaattttattataattgagtttgtacgttaatcactcatattttcattttataatcttaaaaaaaaactttgaaacatggtgtatgtcaatatgacttatttaaactatagttttttttttactatttaaactatggtttgttaaaaataaaacatagttaaataagttatagtaaaggtactcttgttcttcaaaaaaaaaaaaaaaagaggtaaagatactcttgtaactaaattttcttatttctccgtatcactagaccatgagcattcaatgaatacataacaatgatttgtttgttggttgcctaaaactcagacttgtacgataaaaggatgactacaagtcaacaacaaatatagaagaaataaaatcaaaaaaaaattggccaaattatgttacatatgattttactttaatttaactccataaaaaaagttctatacatgagaagtacaaattgaataaaatggtatgatttttttaattttcatttgtttcaattaatgatttaattgattttcagtttatttaattatttaatggtttaatacattttttttattacagcagaaagacaaaatctatctactcctcatatgcattaccccaagcgcatcagcaagtacccgaggaagaagacccgctggacatgatgacagaaggatttaatacgatttgaatacattttttagaaacaactctatcaaaattattgacggtacctaaattgattgtatatttcaagcttaattatgtttttaatatcaactaggggttggttttttagtctttcaaataaaaatatatatatttttagtcttttaaattaaaacaaaaattgtttttagctcccttccaccatctttttccaaaacaaacatagagtagttatagttgttctatcttgtgtcttttagcaaatcaaagagattctaaaaagagagtatttctttaattcgagagattaaaaattacaaattgtcatttgaaagactactaattaaaagttcaaaaaataattaagtttatattttattactattgctaaacttttttccaaaacaaaaatgctaaaatgaggctaagtacacgttggtggtgacacaggaaacttcccttcatatgccttgtcagtatattaatttacgaataacttgtgctccatgtgattcgattttatttaagtgtaattttttttcttgaggcgaagataatattataatataaaaaggatccaaaaccacaatcaaggagtgatgatttcggaccaaaattgtttgtttaattaaagcatacttctgtctaacttatagagttgacaagtaaattaatactatcactaaatctccactttactattttttaaaaataaaatttaaatttatgatgatattaattaaattaaaaactaaataattataattttgatcttcttgtaattcttaatatgtaattttggtattcttattttaaaaaattataattttaattcaatattcaactttccgtatatttattttttattttaaattttcacaatttcaatctacttatttaatttatttgagttatcatattataaataaaaaatattcattatttttctttatatacaaaacttacaagattttatttaagaaatttgaatccaattttactcctactatcaacttgtttttgtataattatttactttaaagaatataaaagtacaacctatgttatattgttagttaacaataattatcgaggatcacgatgattttgtaaagaattatatctatgcaattttttctttatatacaaagctt

SEQ ID NO: 2 - DNA, 335913 bp, Glycine max
  CDS (45163)..(45314),(45450)..(45509),(46941)..(48763),(48975)..(49573): Clone ID: 240O17_region_G3
aagcttataaaaatatttcaaattttattattgaatcaaatatactatctatagtggttaacaaaaatatgaatatgcattgatttttctagagagggtgctggggtccaaactcgaagcgtatttttgtaagaggaagaaaaatgtcaaatatataatattgaaatattttcactaaaattatcgcacatcatttttacaattattttattgtattacatcatttattgtttatttattttcatgtacatatttcttaacctttttgcatttataaattttttaaaaaattataaaagttaatcacattgtttgaattaactcaatttttatttatgaaatagttacttaattttagtaattttgattagtgattatttgaatcatcattcaataaatgaatacatatttaagtgtaataattttcattagttatttttatgtatgatatttatggtatttaaatttaaaatattatttattttacctattttttttataagccaatatgttttattaatatttatttaccttttaagtagcacaacatttttataaagcaaatatttagatgaatcaagaataaaaaataaaattaatttttatacattattaatataaaaatattacaatatcaattaataaaaagtataataaatataacccttaaagtgattattacggaaacaacaaattatcacttttatatatctattttatttctataattatattcataagttactacatattattttatcctccttacaactactttcacaaatcatccactaattttatttgaaaaaacaaaacatggaaaaaagttagacacaaaaggcttgtttccctagtaatttatataagagaataatagtgtaattaacctgtgtgactgcatacaccttttacttattaaaattggttggtatgcaatctctgtctatgccatttcaatttcgatctaacccttgtgttgtatcaattcctcttaccacagttagcataagtaacatactcacctttattccaagctctaaccatttcgacttgttgctaactagattgaggatagtgatctttgtcttcgccaacaacatcgtccacttgaacaaaaaatcaaaaagaccctgaaatatctgaacttttaaaagccgcactttttatttgttgtgtgtgagattttgatttgatgggaaaatatcttgaatctgcggcgaggctggcggagctatcgcggattgtgtcatctgctgcgaagcccaacaggccaaagagagcgctacccagatcgcccaaccgtgtggcgactcctcgaagtgcgaacccatttggtgttaaggtcgaacctgcgaaaaagatggaacctttggaagaagaacaacaatgtcggacacccctcgccaaggttgtctcagattgctccaagcgctggttccaggacaccctcaaggaggctaaggctggggacactaccatgcaggttttggttggtcaaatgtattactctggatatggtgttgcgagggatccccaaaaggtcttttctttcttcttatttttatcattctatgtgcaatgtaataattgattgtacaccccttgtaaagggtatggtcatagactcatatatattagtgcttgattcttttaagttatccctcatttgatgccaaaattatgtgattttgttccctccttggaattggaactgagatagagtgcagggaagttgggcattttacttgctgttagattttaaatcccttttcttgtgttataatttttatcagattgttgttttttgatttagaagctctctcatattagcttctccaaaagctggtttttaagtcaattttagcttatcagattgttgtttttccttttattttcttctcctataagtgttcatggagaagtttatccaaatatgcctttaaattgctttggtggaaggggctgttagggcttctaaatcttgctcaattgtcaatcaagacccctcactgcagttaatttgaattgtgtaattggtatgctattagctgcttctcaacttgaggttactgactatactgtgacaaactttgtttataggggcatgcttggattagtaaagcatcaaggaaccgaaattcagtttggaaattgtgcggtaaacggccaggtaagctctaccttttgttggactagtgaattgtggttttatgtgtcctgattgatctctattttgtgacattcaggttacagagcaagtgattctgattcatgtgaactggaggaaaaagataaatattttccttaatttgcaagtataactctttatttttttttcttctaaaaagattgaatttctatttcaattctatggtatagtatatgtgaacttattgtcactgatactggtggttatttattgtaacatccaaaacataagtcaaattttgttaactgacagttgctctacaatggtgtctctatttttgaattagatgttgtgttcattttcatgaagatgttataatatactagtaataacttaaaacaacaagtgtatagcttatttcttatgcctatgtaagcattgtgttctgtccttttttccccctccaaattgatatgctcctagtattgaccactccgcatctaggacttaaagagaaactcttgcgcttagactttcatccatactcctcaattccatgggagatcatagctgtaaatgttatcttctgatggtctgataccaaaaagcatctagtttacttttgccttgctgcaattagtatgataagctgcctgaaactaattgtgtttgattcagttctcattttgaagaaataatgcactgactagcagtctagcagtattgttatctaggattctaggtgtattcagtatgatatgccgctatagtatgaagacttaaaaggtcaggctgctgggcactgacatctattttgggtatctcatgtcaaaatcaattaatacttaggatgcatttggaagaacttacttatttacaacttatttggaattacctcatgatataagctcttgtgtaaatgtttctgaaagcttataaaattagtttatgatcagttcataagttatttttagctcattaatttcagtaagctctggatagcttatgaaaatagcttacaacttatattaaaacagtttaacattattttctcttcacttatagaaataacttgtacataagtgcatgtatgataaacactcgattagtaagtgcttaattaagatttttaaccaaacaagcccttatgtagtgtttttgggtgttgttgctgcaatcagtataataagctggcaagtacaattgatatttgtttgtattcagtgttatatgtcttgtgcctttgagtcaattaataggatcacactgtgtatttagttaacctgataagtaaagactgattactgaattaattgcatttgcagcattgcgagcccaaactgatatttgcctcatgaaatatgaaagatgttgattactaatattccactataacatataattgcttgtgataacaaatggataatcactttttggttttggttttacaaatagaaagcttgcatgctatcatgtttgttgacgatcaggacctactaatgggaatttagagaagactagggtgtggtggccttttacgttgtgctatattgtcttttctcatgctattacttctcaacactgggtagaattcctccaatttgcttttttatctcttataaagtaaatggcgattaggaagcaattaatatcacatgataccggagaagaatccattttaataattgaccttggtaatttttgtgaatgggagtcgctaactcaaatatcagataaatgatgaaaacataacatcatgaaaatagtcagtgttacaaatgtttatgttaacggttcatttatagatccaaaaaggaaactaatataattcaaatgattgataaactaaaggacaaattttacatatggttttttaggtattgtttttcactcagaattaaagtttcaatttgttaatatgcataatcattcatggcaggggagaagtttttttcctatgtttagaaatcatgaatcctaagaatcatttttttttggaaacgagtaaaatctgtttggttgaccatagataaattttctagaaattaaagagttatataatatttttattaattatttatcacatcaataaaagtaatatgatatttttattataataaaagaaaaattaaacttgaaaaagtaagtttactacaatgagaaaaattttcttgttcgtgaaaaaacttgttaaaaaacatttcctaaaaatattgttctctaggaatcttatttttaacggatatcaaacatgggaaactaacatttttatctcaaaagtttcataaaactcaatttttccccaccaaacacctcctcaattgtagacctgtatttcaaatattaactatatgaaacttcaattctaattgaaaaataacaaaacaatacttatgaattatatgtaagtgttgtcctaaactaaactaaaccaatcaacaaagaaaataactcaaattctaattgaaacaaatgaaaagatcatttcactgttctagataaattttatgatatataatgtaaaagtgaattaatacctaaattaagatagtacacaggcaaacttcaagaaaagagaattaatgaaagatttctacaattacaaattattaattcattgaatagaagaagtcccaaagccttttgttttccagtgaaagaaccaacaaaaaattggttgaatagagagcattgcgcgctttagttgatttgatgataattgaagataaagatttatttatattgtttcgctatatattcctatgttgttttgaggcgaagtatgatgcttgccgacctcacttgctaattagtggaatccagacaactcccaaaccttaaaataggattaaagtttcaccttttgtttgaaatatttcttacagaaagtaaaagcttccacaattcacgttaagaatccaattctgtcttgtatttgctccatttcacgcggtttcgtaaatcattagaaccccacttctctcttttttttttctttttttctttctcttccacttctcatctctgtccaaaccatagagttttactcacacctcttcagctttcaatcatggcaaatgtaaggctttttattaatttcttgctttctatttgcaactatgagactgagaaggcttttcttgttgcatgccatcatcaggttgtggaagtgaaagtcggtttgcactgtgatgattgtatcaagaaaatcctcaaggccatcaagaaaattgaaggttcttaattaattttctcaacaccaataacacataatcactttttgtgttaattagtttaaaatttgtgttctttgcagatattgaaacttataacgtggacacaaagctgaacaaggtcattgttacgggaaacgtgacaacagatcaagtgatcaaagtccttcaaaaaattggcaagaatgcaactgccggggaagatactcaaaccaataagtgaacttgtttaggataggaccctttttttccctcgaaacatatccttctaaactatgtactctgaaattcaataatctatatattgtgaatagtttaattttattcttgaatttcaattgcaacacttgatatatatgttttttcttctttatttaattttaaaagagagattagggaaccattggatgattgattgattatgcagttctttagctgttctgaagtttcatttcactaacctatgtatccttacatttaatgtaacttttattatgtaattttgttgacagattttataatgtaaattactgacacgaaatttctatttggattaaaaacaacactaaactggatataagtcttgtcttttatttgggaaatttaatttatatataccgatattataaagttttttcacactgatatttacttgtaaattattttttataataaaattgttactctttaaaagttatacctaccaactaatttttaattaattgataatataaaaaactaacagcacataaaaactaaaatctatttaatgttataatcgatttattatttatacaagtgcggataaagttgaaagaagcaaaaaagtgaacactaacaacaccaagtaaaatattaattgttggctacctctttctctcacgtataatagcgtgaagtgttactactgaaccgtggtgcctgatagcaaaaaaattatttttttgtgacggtcttatccttgagtcgtccctgtaatctagctaaagtaaatgttgcgtgcgttcgctattatatatatataattgacaatattaaccattaaccacaatgcatttgtatggcaatagcttttcgatttacgtagttctgtggatttgctaaaaggtctcaagttaatatgatttgtatcctccacacccaagttgtataaatatagatataaatatttcctggctttgctacaagtctatagccaccttacttgaaggcaaaccgttaaatatgtcaaatgcaaaatacaaggtcaacctcttattctcttgtgtatacttcttcatgggtttagagcactgttatccttcctcttgtttttctcaaggaaattaaagtactttttaacaataagcacaagaacaactaaggttttttttttcctccttgatattgattcacaaatatggccgctgtatctgaaattggaaacaagacattggtatgccaaaatccccacagttttggtcactttgatgtctggcaccgaggcaacccattagaatcccccacttgtcttctctttctgcaggtctctatgatgaccatagtcacacagataatggacgcatgtctcaagccactaggtcaatcctcccttgtatcccagattcttgtaagctttctctacattttacaaggtgtttaatgatggtcactagaatcagtgctctatgaccatgtaattctaaatatctacagaaatattagtaacactcctttgaatacattttttagtatagattaaaatttgttaaatactataaagtttggtggttatgcattttacaagaaagacacttgtagattgacaggactatgatagctgtaataatttctcgtgatagtgtgtgttgctaccactcctatcaccaataatgtaaaaatgtgatttgtgtatcaataatgtaaaaatagcgtgttgttaacaaatgatgcatggtaacagggtggagtgctgtttggcccctcaatgttggggaacaaaaacattctggggcaaaccttatttcctgtgaagggtgctgtagtgcttgaaacagttgcatcgtttggccttatgttcttcttcttcatatggtgtgttaaaatggatgttgccacattgatgaagactgaaaagctggccatcactgttggtatttctgtgttcgcatttacattggtaatccctactggactagcaattctgttgaggaaatatgctacaatggacagcagccttgcacaggcactgccctttatggctctctcacaaaccttaactgtattcattagcatagcagtgctcttgaaagatctcaaagtccttaacactgatatgggacgtttaaccatgtcagcagcaatgtttgctgatatagctggctttaccttgacagtgatcatttttgctgtactgcagaatcagagtggtagctttctgacactagcaggcctccttctgtccgtagttgcactctttcttgctgttatatttgtgatgaggccagcaatactttggacggtaaagtactcaggtggcggttcggttaatgaaagctgcgttgtttgcatctttctcttagttctcttatctgcatttatcagtgagttaattggacagcattttattatgggaccaataattttaggcctggctgttccagaagggccacccataggaacagctttgttgagtaaattggagacaatctgtatgggatttctttatccaatctacctcgctgttaatggattgcaaactgatatcttcaaaattgacttgcaatctctgtggattgtgggtctcatactgatggtggctttcgttgtaaagatttgtgctgtcatgttgccaggatacttttacaatctacccatgaaacaatgttgtgtcattggcctccttctaaatggaaggggtatagccgagcttaccatgtacaatatgtggattggaagcaaggtatgtatctatgtatgtgcatatgagattgagactagtgaatttaatttcaaattgatgccaaaaatgtgtttcaggtcgtcaaaattagtcttaaggcactgggattcactgattataaaaataagaataccgaataccgaaattatcatttttaaagtatatggatgaaacaacaagtcgttggttagtgtagtattggacttcattcccttaaacaggatcttagattcgagtcttgtagatgaaaaaaatataattgggagggacaaccctactagaggtggtcagccagattcttcaacagagattgattatcagcaaagttaatgatattccgtaccaaataatatggttaacaaaaaagtatatggattaagactaaggttaattgagggacataataaaacacattttacccggttgattaactaacagtctaatacttgttctcttgtctatggtagttaatatcggaacaagagttcgctttgatggtggcctccattgtagtagtaaacgctatcctagcaccaatcgtaaaatacacatatgatccttcagaacaatatcagaccggaagaagatgcacaattcagcatactgggcgagatatggagctccgagtcatggtgtgcattcacaacaatgaaaacctcccaacaatcctgaacctcttagaagcatcctatgcaagcagagagagcaagattggggtcacagcattagtcctagtggagcttcaaggaagagccaggcctattcttgttgataaccaaaaccaactccatgatgagctgcgctcaatgtcttgcaacgcaagtcacattgagaatgcattgaggcaatatggacaacagaacgaaggatatgtatctgttcaatctttcacttcaatctccacctttgaaaccatgtatgatgatatttgtagaatttcattagagagtggatccaacattttgatcttgccattccacaagaggtgggaaattgatggcaccgttgagatttctcataggaccatccaaaccatgaacattaatgtcctccaaagggccccatgttcggtgggaattctagttgataggagcatcttgaatccttctccttcactcttgatggctagagcagcattctatgtcgtggtgttcttcattggcggtcaagatgacatggagacattagcctatgccactagaatggctaggcatgaatgtgtgtatgtaaccgtggtaaggttccttctatttggagaggagaattctaaagatagaaaacgtgacagcgatcttatagatgagtatagatactataatgccagaaatcgtaggtttgagattctggaagaattggtgaaagatgggatagagatgtcaacatgtataagaagattgatagattattttgatctagtgatggtgggaagggagcatccagagagtgttatttttcagggacatgatgaatggagtgagtgtcaagagctagggatcattggagacatgctagcatcaccagattttgtgaccaaggcatcgttgttggtggtgcaacaacagagaataagagggaggcttgttacacataatgtgaatgccactccagtgcctaatcaaagagatcagctcctacatgatgttccaattcatgaaacctttagtccttcatgtactatttcagtggacaaatatgacaaaatgtagatagattcctgtgtttagtgaattttccttgtcgatatatatatcatgcaaatcacagattttcatttaaaaccacaatataatgttactttcgacaaagccatgaaaaaataaaattgatcatcacatatggttagtacttgatactaatacattgccctcacttaataattttgaattaaaaaaaatacttgaatagtggaatggtactaacttccttaaaggtgtgaagaggcataaatggaaaaatgtgattttatttaatataaatggctaaatgagtaaaccatgtttggttctgcacaatagttatgaacgttcaaagtctgtcctacccaactttgcatgatattcaaccttacgggcatgtaatgaggaaatccccttaattttactaaaataaaaatcaaaacaaggataaaaataaaatacagataaaaaatccttaagctacaagtctaatcagaaagaaaaaaatatgatccagaatcatcaaatgtttacaattccaattaatctctttgtaacacgtaatgttaattcttttcgtaaattaaaaaaattcaactacatgttgtgtaaatttacaaaaattatatacacataacaatctcaaatcaaaaaataatttctgaatgctcatccacagaaaggtttaaactgcacgtcttcacaaggtggattccttaatacagtcagtgtatatatataaacctaaaagtaatttattagaaggtgctaataagttggtgaagcaagccaatctttccataaagcaatggtcatggaaggtgatacttggaaagaaagtacctgaatttcttggtaaagcaagaaattatgtaaacaaagacattggcgtcaggaaacagcatctccattttaagtgccaatttatggtgcgtattcaaacatcatgtcaaataaaagaaagaaattcttacgactttgtaccatttcatgctgtaattgaggggtacacattttttttccaacaacttgaggggtacacgttgaacagaacctaaaccgttctcgtcgaataataccgattcgacaaataaaaaatgaataaattatattggcaaaaaaaaaaatagaataaattatactttattttccaactatttcttacttttttagttttctctctctctctataagttatatatttatatacaaaaagacgaaattcgtaaggcaatcttattggtattataattttctctactgattatgtctaaccatttatacacacacacacacacacatatatatatatatatatatatatatatattattacttgttaaataaaatcagaaaaatgttgtaatcactttcaaaactgtagttaataaaccttaactaaatcaagcaaaaacaatggataagatggaagtttagtgatacaaaaatatatacaggtatagtgagaataaaaaagttgaggaagtgtgaaatctacgtgaagatgaaggatgaaaattggttaagttaggttaggttagattttataaaatatgtatgagtttgatttgttttttaaggttcgagcttagtttatatatttagttgatatagactacatttaaaagactgacttaaaagtctctttaaaatacataataataacgaaaatggattaagttagatttgtttttttttctttttactgggtagttagattaggttaatctttataaaacatgaatttgatttgttttttttttcaaaaaaaattaaggttcaagcttaatttatttagttgatatagaccactttcaaaaatctgacttacaagtctctttagaattcataatagtgacacttgattaagttagattagactttataaaacacgagtttgatttttttttttaataataattaaggttctagcttatatatattatatagttgatatagactactttcaaaagtctgacttaaaagtctctttagtatacataataatataaccttttaatttagtttaaaaatttgtccctaaataaattaataaatccaaacttatatacaagttaataggtttaagtcttaatatatatatatatatatatatatatatatatatatatatatatatatatatatatatatatatatatatatatatatatatatagagagagagagagagagagagagggtcattttatacgagtgagaaaatttaaatattattatgaattgtcaaaattaaaatacacacatgccacatgattttcttaaaaaaattacgtaacttttttttacaaaaataatcatatggttttaaaaactaatttaaataatttatatataactatatcagttaaatttgtttcataaaataagtatatcagttattttacaaaattataagtattcataaaataaatacaaaatgataagtaccaagtgtatggatcagcttatgcgatgttgttccaatgtaactaataatcttaaattcgagtattgaatcgaatatgcaattcatttaaatactttaagagataatttgtttactcgtaataattttatttgacttaagtaaagttttctcatataaaaaatacatatagtctataaaaaaaacattttctgactaaatatattttcacaggctccacacaaaaaggaaataacaaagttttaagagaatgtatatttacactcatcagtttgttaaagttaaaattaaaatggagtagaaattgagagaaaagagaggaaatatttaaaataaaggttgatttgtataaataaaatgtgaaggaaagaaataaaaaactggtgagtattactcaaaattatctttatactgatgaaaggaaaactgataaagaaagtaaacactaaaaaaagagaccaacttacaactaacatttacttcgagcatagttaattaagtgtttgggacataatattgtttctataactaagtcttacgtagattaaggtttacgagacctatcctaaaaacatgaattgaaactagtatcacctgtcttctgggctcaatcctggggattcataaagacatttcttgaacaatcaaaggggttatatgaatggtttaacgatcattaatgtgatattgattgacaaccgatcaatgctagatatataggcttaaaatcctgtatcagtctacagacgactaatatgatgtaaaattccttagttttaagtgcttttgaacatcaagagacttaaagttccgtgttggttgacaaacaaatggtatgatatataatccttcaacgtaaacacgaaaaaaaaacttataatctcgtgccaatcatcgatacagtacaaataataaattaaaatgcaatttttttcttgttcttattttttcttatttctcttaaactagatactatcgaatccattctatttcttatctgtttccattattctacttctcacttattttcattactttattcctttcttttatgtttctatccactttatttatcacctatttctttctttcttaccgaatactaaacaagccttgtgatccgaaagcccgaaacaatcattttttatgaaacagcttacactctggtggtgtgttgtgtatagttaaataagcttttaaaaatatggtaaattataaggtgagggaccaaaatgtgagattgaaaataaccgtttcatatattattcaaataaataaatggctaaaattgaatcattctccgcatataatgaccacccatttattttattaatatatctaacaattatttttaactccatataggcatttttgaccctcatcttaaaactcacctcaagaaatatatagttattttaattaaattagtactcaacttcaaattaattattagacaagtgttgttttttaaccatttatcaaattaggaactttatgtcacgttatcctaaaatcgttacataaatttttaatgtcacgatacaattttttagaagaaaaatttgtctgaaacccatatgacatgggatgcattagtcaaagtaacacttcctaaatcatcaacttagttagtggcatgcaacatggcgttaacctatttttttttttctagaaaaaaaaaaacatataaatatcaccagctgatgtcgcgccaccttcaacgcccagcccagtgtaggcgcactatgaaatcaatgcagtcagttttgtcatgtcagacttgcaaaaaaatctccaaaattatatcacacttaataaattttataaagtattatgcataatatttttttaaagttattatgcatagtatcttaaaagtttcattaccactatttttcattagataaacttatttaatactttgtgtaggctcatatataaccaaaaagtaatcttgaatgctagatttaaatataaataaatttattttatcttattttattttaataatttttttattcatcatgaaagatattgtaaaaataattttattttccctttgagattaaaaaaaattaaatgatatgaaccaaccttttaattaatatgaaattagttatttttatttatatataactttagataacatatttttactcaaaagactaaattaggtgggaatgatggtcagattaagtgttgtggaattattgaagtcttatattcaaagtcctaacttataactatattaaatacttaaaagttttttatcatctataaccatcatattcaattctaaaagaattgtttctactaaaaaaaaatccgtgactcagaaaaaaaacattacttgggttgatttttgtagcatctaatataattaggtgttgactctaatttttattttgacggaagaaagttcagaatgacgagaaagtgttgaagcaatattggttgtcgacttgtcgtgtctgagacgtgtacgtgtaccttccttacctaaaaaatgacaattaaaaagtgtttattcgggacgcgcttaaccaacttcacaattttttaagtaccactccgggtgctatgttacatgggcgtcagtctattttttttttctttttaactaagaaaaattagtattttaaccaattatataattgtgagattaaatatttaaaatatataattaaaatttataataaatatttttttaaaatatattaattatatttgtatttataatgaataatttatataataatataaaattatttttagttattgatattaaaaatacagatgaaaaaaatatattgaaagagatgaaaggttgagaatttttttaaaaatattgttattgaaaaattattagaaaaattcattgaagaatagttttaaaaaaattctcattcaagataattattcttatatatataaatttataaatgatttcatgtaatacgaaaaattgttaatccacatgacaatcttagcgaagtggcaaaactgccttggtaaaaaaatttcataagataatcccttttaaataattaatttgtaattaatattgtgccatcctcgttaccttctgttcatttagctttaagaacaaatttatgtttcgcatcacgtaacgtgtgtgtttggaagcgttgaaaccacatttaatgaaagaaaaaaaaaacatattctaagacacaagcaacaaaaggaaggtttctttaacgtcagttaggttgagataaatgcgtacgcaaaaacagttaaatgattagcttttagaaaaagttagaggttataagaaaacatagggaaatgtcactaatttgttatactttcaataatcaagatgttagttttctctttcaaaaacatattaacttgttctctaattaccatttttaatttttaactacatttattataaatactttagtgaaaaactcatagcagctattccagttctgttcatgtaaatatcgtagaagataattgcatttttttccttttctttttctaaaacaagaaacgtgtgaggaatcttaagaattaagatgctaatttaaaaagttgctgagttagagcataaaagttcaaataaaaaataaatgaatagacaaactattaaattattaatagccttagccttgaatctgatgcagacgtgtatggcaatggacatagaagcattaaataggcctcgttacattcaagtttcaaccaaattggcagggaaaatcctctgatactgttgttttcctgaaaccatcacaatttgtttctcaatcatgtcaacctcatcctcttcccaaagcctcaaaattggcatagttggattcggcaactttggccagtttctggccaagacaatgataaaacaaggccacactctcacagcaacttctcgatctgattactctgaactttgtctccaaatgggcatccattttttcaggtaagtcaaaccaaaccaaaccatgcataaatacatacacacttgcaccattttgctggaaatcccacgtggatcagtgatatagtcaaaatagtgtatataaatagagaacaatttttcacttacgagctgattttgtgaagttaaagtctaaaggcaaattctaagacatttcatgttccgtatgtcaaacattacgcagggatgtcagcgcattccttaccgcagacatagatgtcatagtgttgtgcacatcgatattatcgctatccgaggttgtcgggtcaatgccactcacctccctgaagcgaccaacgctctttgttgatgttctttctgtcaaagagcacccaagagagcttctactgcgagagttgccagaggattcggacatactctgcacgcacccaatgtttggtcctcagactgccaagaatggatggacagatcacactttcatgtatgacaaagttcggataagagacgaagttatctgctctaatttcatccaaatttttgctactgaggtaggttaatatcctttgtcaatacccatcaatcacgaaagaagaaagaatcatttttttttttttttattgggccagtttaattatgttaatcaagaagaaagaaacagagagggtggaagctaagtaacttcagacgtttgcatttgataaatcaagatacaagataaatctatgttgtaaaaaatgtaaagtctcagtcccacatctaacagaggtaaggattaccatcaccttacccttataagttatttgttgatttgagttaggcctaaatttaaacttacaaagtatcaaaggttatcttggatctattaataggtcacttatcatattacctacacacaaaacccaataatgtggaccgtgagagggtgtattgagaaatatcaacacgttgattttgtgaggttaagctaggccaagtccaaattgaaagaatctaagcatacaatcctacagccaaggttatagaacctcaacgtcattattgaaaacaaatgcatattaaacaattcaatcttcaattctcccctggactgagtttgaactaattcttcataagtttggaccattgttgcttggtttacaaaagaatcacaaaaatcagttgtgaatgccttacatttatgattcatccggggtacatctatttcactgtgttttgttacttttgtattacgcagggttgcaagatggtacagatgtcctgtgaggaacatgacagagcagctgctaagagccaatttatcactcacacaattggcaggtatgcagcttcctacatatctaataaaccattgagaagcactaatataaatgctcactagatgtaacttttggctgcttcttgatcaggacactgggagaaatggatattcaatccacacctattgacactaagggcttcgagacacttgttaaattggtaaagagttgttaacatttcccctactttctctaaaaaaattcctttatatgtggttatgtatcatatggaaaagttacttgcagaaggagacgatgatgagaaatagttttgatttgtatagtggattattcgtgtataacagattcgccagacaagaggtaatggaactgccaacgaaatgcttatttacttttaaattccattttaaagcactgaaccaagtaccccaagatagactcatgaattgtgaaaaatatgcagctggaaaaccttgaacatgccttgcacaaagtcaaagaaacgctgatgatacaaaggacgaatggggagcagggtcataaaagaactgaaagttgatgcatatttattttacaagatattttctctaactctcaaatatcctcctgcagttccaattataaattactcttatttcagtttccttttaccaaaattgaagttcaattaataaaccaaagagactggtatatgttcaatcacatgcgataaaaatgttccacgttcttgttccgagcagattctttgtaatttcataaagttagagaaaagaaaaaaaaaacagacatttagtcgccaatgcctaaaaccatataataactccacagtttggttctctgaatgaattcccttcattttaatccaaatctcaactacctcttcaattctaaacaaataaattagaacactaccaagtgatcctctggggtcttgacatgagccttctagttctagcttttcaatcaatgtatctacagagcatgtattccattttggattatagagaaataatgtaaaacttttaaccaaatgttactgcaaatctaaagaaagttcattgctccatgataaattgataatactacataagatgtacaactgctgattttatatatcattttaacaagacttgccaagagatatatcccttaaagccaagagcacttatgtttcgatttgagacacctctatttattccacttacatttgaaaaataaaaatattacattcaccaaactgggaaatgggaaatatcaaaacgtatagaagtgagccgtggaaggaattgtaaacaagttatgacaaaaaccagaacctattcctttgtgcctattttaccagcttttcaagaatagtacaaaattaccaagaaaaaaaaatgatgcaacgtattttcaccacatttatttttctctctcatcaatgctggcttcttctgtttcgttgcataaaattgcagcaggattcggaggatctgatgctgatggctctgtctttctaacttgtaggccagtaaagcgcgctaggtcaatccattgctgcagcaactcacgaaaacaaaaaattttaaaactcctagtcaaatttagaaatgtatgtgcagatgaataattcacataaaactaaattatactccattggttttaaaacaattgctactcttgattcttgaggttttagtctgtttcaaattatgtcactttagaacatgaagacgacattgcttttttctttgtcttttattgtttctctaactaaaaatgaaagcaataatggcggaagaggataatatagtcagacgaacttagggtttccttgaaattaagaatatttaatgactttattaatcatagtagaaaacattaaacaattattgtgaaatggaagggaagtatattgcaatatggcaaaagcaaatgctaaaacagtgtctttacaatattggctaaaaagtaaaaagtcaaaagaaaaaagttattagaaaatgttactaataatacatttccattgtgattttcaatacatccctaatgtaatttctaataaaagaaattctattattaattcctcaagaccttattacaaatgctaatgagtttccttaagactcttgtcaagggattaaaaaaataaaatatattaaatgaaaagtaatgtattacatgttgtacttttcataaaatgctctatatttttggcttaattatacttttgatcttcttactttttcaattttgtaaactttatccctctattttttttccacaattttgatctctaattattttaattatccattaacttaacatccaatattcgataaatgtgctgacatggcagtgtagaagagtgtcatgtcaacatgaacgtgttgacatactagcaacacgttaacaagacccttttttattccttaacaagcaccttaatggcactcgttagcaacacctttgtaatattaagatgacacattataagacaagcggaagttattttctttccttaacttgtgatttattgttcctagacaaaagcacaagctgacgcaattataactcctcaaaacacatatttccatattaacacttgaatgtgaaattcaccactttaaaaagaaggaaaaattaaattagatttttgagaagaattatagtgttcaaccataaataaatgaaatccacttactgacgagattgtgaacattgagcattgaaagtgaacaaaagcagatagaagataaggaaaaaaaactgacctgggttccccaatatgaattgactgtccgtgctacaaaagaaagcatatttacaaagaatgtttgagaagcaaactgttcagaaatccgatgctccactatcccagcaattatctgctcaacaaaaatattataatttccgtattaatacaaaaaaacagttccaggcattaaatggatgtatatttgttgaatatgatataaccaaagatgtagtcacagaacaatcaaaaatcaattttaagaaagaaagagccttaaatagttattcagcaaagtgcagatgaagaagtagaaaggaggagaaaattacaaaatcagatataatagatattattgaaccgagtaattttttttccacgattacttttaatagcatccagggtttactaacataatatttggttggaaaataatggagaggaaaggagggcaaagatttggaaggaaagggagaatggaggggagtaaaacacctcctctatcaattttggctcccttccaaaattgggagaatttggagaggagaaagttttacatgaattggactaaactatccttaatggttttatcctattatgaggatataataaataataaattattttattttccctcttatttccttgtgaaccaaaccaagtgttcctcccctctactccctttctttgaacaaaatagatagtatacgatgtagtctaatctttcctattatgcttgctacccaccatctacttcaaacactgcctaagtggcccgaaaaacatagtgtacaaattagttattcaagacacagctggtcaagtcctgctttcaaaatgtctacatgaatttccaaattgtatttctgtcctgcttcaatactatatattggaaaaaaatcaaggcatcacataatcaactattgagtattgaaacataaaccatcgacgtgacaatatagaagccttcatttcctacagaaactaggttcaatcttccatgaagtctattgctacatattagttaaaatgaaaactttatgcaacaaacaagttctctatatacctgataacggagatttgcagatattccaagaaagcatgcatatataaatgcagttttgagtattggggacctcataatccgttgttcagtgacaactgctggattaaggactttacgaattgcatatagagaatttgatgaagccacagctcctatgcttgaaataaatccaacactagcaagttttaaaccaccaaatacaactgatgcaatcctatgattgagattccagtttatccctgcaggattcttttgaaatgcattgtccgggatggagccaagaagtcccattagagaaccaatgttgtcgggtgctttcatctcatcagcatatgaaaggaatgacaaagttggtgcaggaagccacactgtaaagaaatcaacaactgatcctctgacagtgtccgtaataacatagtcaatctcttggaaaaaattttctttccgcttttcatactgggccaataatgtagttgttattgatatagcttcttctatggctaatctgtgcaagaatttgggatctgccaacaatctttccctgaatccctgtataaaaagaaccagatagtgaagggaacaaggtgatgaatgattaaaagcagaatgaaggtttcattttcaaataaaaaattacctggaaacggtgagtgagctctgaaattagaggatactgctccagatcaaagaagttctgcaatacctctggtgatactaaaccaagatcaattcccttttgaagatcctgaaattgaaaggaaaatatttcctatgttcaccaccaatattggcacacactatcctgtctaaggtatgcacataaaagagtaaacagaagcagagaaaaaagaactagaaagtagaaacacactaactacctaatcatcaaatgcaagtatgcaactaatgtatgccaaattatagaccagaggtactttattttaagagaaagaaaacagggtactttattttaagagaaagaaaacagaaatagcgacctcattatcacaattcacccattggaaaagtttttatgtccttaaattatacattgctgtgcaatgaatctttcctcaaaaggaatatgaatttaaaggaaaagaaagatagcacaaagacagcactacaaagttgcaagcattcaattaaaatcccccacaccagtaggttgagctgcatgatttgtgtcaattaataaaatgcaaaacagagatatcaattaaagggataaggacccatttatttaagcttttaaaaaaatatttttttttacatattttatgtaaagttattttatttggttacaataattaaaaaatgtactttatattataaaaagtagttataattttgactttttttcagctgctactcaaagtagcttctgaaaataatcatatagatagatagattctgattttttttctaaaaaaaaacttaaacaaacacactaagaaattttagaagtgatttttcatgaaaaaagttgaaacaaatgggctctaaaatgctcctgaaatgccaaagttaattgcatacaaaaaaaataatcaataggtactggcacaagacacctagtaatatgcgaaatctcttatgtttgtatcaccaaaatggacaatgagaggacataacaacaacaacaccaccaaaaccttatcccactaggaatgagaggacataaagggctaaaaattggaaggagggtctacggggcaagaagattaacagtcaaacaaattagtaactgtaattgttggtttacctgtgggagggcatctcgcctccgcccagcagcattcataacccgagcaatctcagcacggtcaaagcaatttctactacagggtctcgcagcagaataccacaaaaaatcagcaacaggaacttctccttctctgcgaatgaattgtctttcagggtcaagtaatataactgcatggtttttcttttgtatttttcctgaaattcttgctggcactccagttcctctagatccatatgtaacatggcttgcaccagtgacaactattaacataccagtgacccctccatcaagcacattttgtaagataatctgggacatagaatactcatcaactactcgagcctgtgcagaaaggtatgagcttggaccaaaaggaatagacagattttgagtactatcaacagaagatctgcgtgagatagaagtaaagccagatatgaagcctgaaccagctggaggtgcatatagtttacgttcatcctttgtaagcccacgaattccttctgcttggacagttcttaagatctgttgatgagaaaagttcaagtcttaattgtcatctttatgtgtcttgacctaacaatacaagaactgagcctaatcctacaaggtggagttggctagatggatcaaatgaaaccttttagctctatcaaaaaccaaaattgcaataaagtttctcaggttgccctctaccctttcaacagattatattcctttctcatatcttgacatgatcaaactacttgaggcaacttttcataatcatatcctcaatttttttatgtttaactttcagtttaatatgggaaggaatctttgaggattatgtgtttatttccaattcagggtctgttctttgtagactagatttttctagtcctaacgcaaccaaaatccttaagggcaactttttacagcacatagcttttgcacttattggaagtcaatttgacaagcaccaacaagtatatactatactactccctccattccaaaataattgttgtcctaaattgttttacacagaccaagaaaaaacaatagatagatgaaagagagttgtagttttacaaagttaatcttatatcatcattgattcatttatagattttgtttccatcattaatattataaggaatatacgtgaaaaaatgtaattaaatattatattcaaaactaaaataacaattattttggaataatatttttttcttatacgacaattataatgggacagagggagtaacatttttctgttgctcctaattatagccacaccacaaccataattttcagagacaaaataaacatttgaaagatcaacatgagtttggatgaaatttatgcataccttcagtggtgtaccacaagcaacaagatgaattccattttcgcgacagtagctcagaataggttcatactcctgccatctttgaggcggccaatgcaacgtgtaagacttcaaggtgtctccatctatcctgccatgaaagtcaagtttcaggacaagtaatgcagaattatggaaaagcaatctgactaagacaaaagagcttcagagattaacagaaaatagtgagccagaaaaaagattgcgagacagaaattggtcgccaacaaaaagttgtctcttttataatttttaattgaaattttcttaatttagctaacatgactttctacggccacaattgcgtttgcagacacttaaaaaacttgatgttgcagcaaaaatcacgttttatttattattgatgtcaattatttaacagttttatgttaggtttaataacagtaggttgatgcaagaggctaaacattaatcagaaattgaaaggcagtgttattacttcttatccatatactgattgagcggttcctgaagattagcgggaaaaacttcaagcgccagagacaatagtttttccttctccaaacagcgcctatgcaaattcttcacaatctcaagctccaattccctatcgtctcgaaccggaacttgctctgcttcacctaaatacaccactcgagcattcatcaacttctcccacactttccctttctctttccctatcgccaacggttctcctatcaccgtcgcgtcgtaaatcctcgaagttatcacttcctcctcctccttcttcttcggcggctcctccggcttcggcgccgaagccagaggagattccgctgccttctcctccgccctcgccgtcgccgccgagagcaggattgatgcgccggcgactaagaacggcgccatcagcacgccgcgccggctgctccgagctcgagtatcgccgtcgccgtcggaaccaccgggattcgaggcggcggtgacgcgactcgcgtggcagacggaaaggctgacgcggcggcgtttggcggtcgagacgcggcggaattcgaggcctccgggggcgtcatgaggagggtccgatggcgcggcacgtgcggcagtggcgccgcggaagtaaggcacgtgcgggagacgagtgacgaaagaagaagccggagtgtggggcttcattagtttcgttggcttcagtctggccttatcatcaaccgcaacaaggtttaagttttgtcagttcacttttttcaactgccacacaaaacacgaacaaggattcctttattttcagcattacaagattccataattattattattattattattttggagaaactttttttttttcctttcaaatatcccttttcatagaccattttaattgacaaacaattaaacattaaataaaaaaacatttattatcaaacagtagatcaatttaggtgtgttagtctaaagaaaaacaaataaataacaatgacatgttttgagagatagacaaatattccctctaacataacataaaacatatatatatatatatatatatatatatatatatatatatatatatttgtggtagaaagaaatattagttttagttcgacatattataagatattagtttctttatgtgaaattcatgttcttttatttattatgtgtttaatttaaaagataaaattatataatctaaaaataaaaaagaaatttttgaattaaaataaaatataagagttgtaggattcatattattttttcctcaaccaaaaagacaccctaaaaaagttaccaatatactttttaacatgttattttaaaagtatttttattaacttaaatttattaaaaattataattttttttaatttcatcttttattcaatgaattttccctataatttgattgttttcaataaattataatcattattaaaaaaatatataataaagaaagtgtatcaagaaaatatatcaagaggttattcttatttttgcctctcataaaatcctagacttaaaatatacactctactttttgtgttcaataataaattcgtatatttcgtggtcgcaaaaaaattaaatgatattgataatttacatagtcacgcaaactatatatagaaggcctcaaatttagagctctacgtgaagcattggtgtccatagagttacatggtgccaattaccatatctttcattattttggaattttcatgtaagataaaatcgatccgagtcagatgtgactcaggtctgaaacacaggtgccgatccaatatccatgtatgccaataatacgaggcgtctactctaatttgattgaaaataagggggcaaaaagtaaaatatatactgccaaattccaattcaattcaactatacgacattgtctaaaagttagaccaaattgaccaactgaagtgatacctctttgttgatataaaaaactcgtgtgtgctatgaatatttttaaaacaaaataatatctatgagataaaaatatcattattgtcaaataatgatgaaatactatcatgtattttaagaagaaaaaatatataatagaagatgactttattgttaattatgtgaattctattttattatataaaataaattaaggttatgtttaaaaaaattagttgaaagttaaaaaacaaactaattgataaccaaaaacttttaagttaatttattaaattataaatatttgatagaattgttgttgaagtagataaaaaatataatatcacaaaaatagatatatttatatgatatttatataaactttaatgttttatggacaaaagtatattgaggtattataattttattttttaattaattttaaactcttgtaaattatttttcattatatcttttgtttcaattattagattttttcatgttgcatattctattattaatcttgtacaatgtcttaatatttttaaccaagtttgaaataaagttgaaaaaacatgcacttaagtaaatattatacttttattatattaattagtataatagttaaaataaattgtataatataaaaatattcagaaaataataaattattttaacattttttactgtcaatttcgtgaagatgttgaaataattacaatggctaagacaaatagtataatataaaaaaattgtaagaggaatgagtgaaaaataaataaataataaaattatgttatatttaaaaggaataataagaatatttaataaatattttaagaattaaaaaataaaatataaaagcaaaaaattagaggctaaaaactagagttttaaaaaagttactttaaataatgtttcagaaaataataaaagttacaaaaaaatacttatttattaaataattaaacaagtttttcaactaataaaaaaataaaactaactaaaataacgtatcaaacatagcctaaagcgaatttaaaaaaaaaaattaaggtggaaaagcatcaaaattcaaagttggtatcaaaattaggattaactaaatttaagcaataatatatgtatccttttcctctcggccccaaagttcatgatcaatcttatcaaacctttttaacttatcaattttgctttcatgcaaaatctagtaagagtaacttcaaattaaatccacgtttgatagtgagactcaagtttaaaatcatatctatcttgctatatgtaataatcatgtttgactgctgagtttgatgggtcaagactttcctaataaaataaaatgtgggtacggatgcttagttttgatgggtgcaaatacaattggaaaaggcatgcatcattaacaatgttttacacgtctaatttctccccctctgattctcaagaggcagggacaaacagatttcacatgcccttttctgggatacaaacatggtttctcactttctcatggtttagccttaaaacatgattcatcgcaatctgcccttaccatttgggaatgtgactgaatagtttggtaactcagaatttgctacaatctggtgataagtaatgactattagatcataattttgttgagaatacaatatttctatatattctaatactacagtgtttctatttctggtttcaaatctcaaaaacaagttatacacaaattcttttgggagaaaataaataataataaaaaggcaagctagcaatcaaactccgcaactaaagatacataacgaggtggtcacagaatagcttatccagtacaatttaagaaattggtatacaaagtatgattttcaacaacgaacctcctttacccaatatttagtcacatttatttgtaacctattaaaaacttttgcgaatagctcccctaataaaaaatgccgcatgattaatcatcaacaggaaaaggctagctcacttgatatcatgaaaagaaggcaagacagcaataagacggtctccataaccaacaggctctgtaaataacaaacaaaaaatagtaaggaattcatcacaactatggatgactgattgagtgtagctgccataattgatggcctaaaatatgtttaaacattgataatttggttgagcattgacgttgaacttcaaatattgcaaaaggacggaaatcgcaatgaataaatcactgaaaaagcatagcagaaattaagaccttaagtaaacaatatttttccattcagtcaatagtcatatactgactagaaaacccatgaaaaccgatatactgtaaattacaatgagctaaattaatttatcatgaatatcctgttactttccatcatttagcaaaaaggtatacaagattcaagatccccagtgtttggtatgattacaaaaaagtcacattattttccactttgttttctgttttaagatatttttgtagttataacttataagagaaaacaagaaatgttttctcaaactctattaagcctagatacttatgcgacccaaatacgggggatacgggaaattcttaaaattcaagatacaacgcaactcagatgcattaacacaaatatacacacacacacaaataaatagagagagacatacatacatactttaaataaatgcacagtatttattaagagacattgattatcttacactaatacataactatatcagtggacgatgatcattattcacaaaagcaatacctatgataataacaaaataaaaaaacaaaaaaacagtgacatatgtttccattactcataccagaatatattattttccaacatgctacaaaatcttccccctaacttgtgtcaaaatgtcacagacatcatcatttgtcctactcaaaagaagaattgactctatatgattgcctagtagtaatatttagtatttactatagctttaaagataaagctgtattgaattttattcctattcaaagtactggagccattctcaaccataccaatctacaaagttttggaaaaaaaaatagaggatactctttggaattggataagtacaagagtatcatatgcgtatcggtgttgcatacaagtacagcatagatactttgtcatttttggagtatcaaggcttcacagctcaaactaaacaaatcaaacccaacatccccacgttttaatatgataacagcatgctagccataaagcaattaggcatccatgatactagagtatcataaatacaggtcagaaaatgctcaagtactaagtgttccaagatggtaaaattcatttttaatgcttatcactgtgactacgagaatttagaattattaggattgccaaatcatttttgccatattttattgctagaggcacactattgctttaactatttcaattttggatgaacagcacggctatcatcactctttctttccccagaagccctgtattactttagtaccatgtaaataaatctatacattttggtaacaggtcatagaaattattatacctccatcctcaacaagtagcttcaacacttctccagccacatcagactgcaagatttcaaaaattaaactagtcagaagtagtaaatatttaggaaggaaccagaattacagaaacagaggcatcaccctgataggaagtccagtgccaaactgatccaaataccctatgacttgcccttctttgattacatcaccctagaattcaattaggaaataaatatattgaaaagaatttgtagtcagttcaatgaaagtgaggtcctcaaacaacttgatgcagcaactgtatgatacaaaatatattaataactacaccagcagaaaaatataggtcaatctatatttgggaaccaaataatatttaatttgtatctgatagactcaagaaattataactaatttggaagaaatggatacctagtattattaaaacaccaaaacactgggcagattatagtagctaaagaggaagaagctaactagtcaaagtgtcacactattcaacactacaaaggaccaatccccttttagagagcctgacctttctcacccaagagctacccaagagaatacacaccctctcctccatatcccctcccatataacacaatcctcaccaactaagcacctacctgacaattccctcctaaccaactctctgctcatcagggttgattctcttctctttccaagactttgggcttttgttttgactaagccaaatttctatctgctggcctggtccaacagtatcttttacagacaagtttacaaaatattcgtatttgttagaatttattgatattcctattatgtccccactgtgtgcaaacatttagaaactaatattacaattaacagtttttgtgaatgcagcaaaactaaatatatatgatatagaaatcaacaaaactgaaaaattatatgcaaagttcaattgaaaagaaaattgattaccctttttgtggtaataaatataatgataaactaggtaggttacagtttggatttgtgatcaattgaagatctagatgctaattggtcataactacaatattttttgcagtgcttctgtgcctcacatcagtcacgtgtgtctatataacttgttcttaaagtaaatattaaaataatataaaaaatattagaaatttaaattatatttacattttttaaatgtattagtaagttttgtttatatcaataatcaattttttaagataaaaatttacaaaaaagtaatacagtaatagaaaaataattatcaatattgtataagctgagactatcattgctaattattatcagcttttcttttttatagcatccagttttttcagttaaatacttaaatttatttcaaaagccaacatatgcatgtcagcaaggtcacatcaggagactaggccgacaagcaagcaggctgatacatagactgcaactattagtttcagcactgcaaaatgttagtgaacaacaaacacatgcaccaaatccaatggtggagttcataatgagaatccagatggagggagtatcaagtgaattatgtgatctagttcataacaaattgatgacataaaaacaccagagaagaggatggatcttgacaagcttatcacatgtacctctttacagataggaggttgcttcttccctttcactgttctacctcttcggaataagccaacctaatgagaaagaaagatctgtgatagctaactctacatagctcaagtcagagataattagtgaaagcagaagttaaaacatatattattgatggatgccataccgtgggagatgttactaagacataggtattggtcccagaagcctccaatgctgccaattttggtgatttctctttggaaacatttgcaaatgggttgttcttttcaggagatgattttggtggtgatggtggcaggctattgggtgctgattcatccataggtttacttgggataggtggtggtgtagtcggtgaaatgttagacaaaggaacctttgttgctccaatgtttcgcttaatatgcatttcaaaatctccaacctataacaatataagccaaataaggttgtgtacaaggtcatccagctaaaagcatgcttcttttgatgaaccagacagaaattacagatttgaagttatattaaagttattaggcacaatgttgtatgaaaacaaagctgagctgacacaattttttatgatcaaatttgcattacaagaaaaactatatattcagataggacattaggcacaatagcaccatattctcaagtttcaattacaatgtgctaccattttgataaaaacataaataccattacctcatttaataatctataagcctgtgttatcttaagtgaattaaaatcatcctttgacataagttcaatacacagtacatggcaggctatagacatatccagacactaattacgaattgcaaagaaccctaccatataacattttgctttagaacatacacttaaagtttttttcatccttgttattattatatttaaaatactgcacttcaaattttacagaagcagtaaacaagagagaagaagatcacctttactttcagttcagcaatttcagtctcatcacagacctctaataccaaagcctgataataagcaaaccagacataagttgtggtttatcagattcacattgaaacatggctgttaacgaatgcaattatgcagtcttggataaaaaccagctatcataagtaaaaaataccttgtatttatttcttctaataactaacataaggtatttgtattcatgagcatacaattgccaattcccaccaaactatcatttttcactaataagataagattttcaggaaaataaaaggaaagaatagctatagacctcaaatccattaggaaaagtagcagtttgcaaaggctttttctccaatgagccttggggggtgttatctgaagaagctgcaacatcataaataattgtaaggtcatggtttacgaatgttaaagtaaaagttgttaaagggaagctattctgatagccaactataacaaagctgtatatatcatataaccttcaaacagacattcacaattaccataataataattagcaacagagtagaatgatttcctactattgtgtatctatgtaaataacataataccttaaaaataaacagataaacaataaaaacaacatcttttgtttgtaaggattttcttctatcttctttctttccaacaagtatataacggttcggcaacattatctttgatcatgtatataaaaatatgaaattgcagcccaaaaattttgcaactggttaatgtatctcaaaatcttaagaataaaaacaacttaaagtttattactaagaagataattacactaagaagtatgaacaaataagagtatcagacttttctcattcaaacaacagccaaatagaacaaaaacataaggatataattcatttcacaatcaatataaacccaccatcagaattggatgtgttgatagcttcagctgtttttgcagatgaaactagtgtgcttttccccttcatgtgggaattaatgtgcttctgaccatatgccaaatgctggatgaaaagcctacgtttagagttccatctggcattatggatgggaagtacagcttgcttctcaaggcaggctcgcacatgggacatagtgcccatgggatctgaaatccaagagtcatgattaagcatctggttgcaatggtaaaatttgcccctttaaaaatataaaaaacattgaagtattacaaaaatattgtattatgatttatgaaaattgaccctttaagaaggcattaagaatctttccaaaaagaagtaagcctatttcaaaaaggctcgggaaaagaacggaacacattgttttatttaacagaaatggatcaagacaagaaaaaaaaaaaaaccaacataacacaaatatttctgacaagtgtttccaatcaaaaatagtatacagcctatgggtaccaccaaagttaataaataataatttaaaaaaaagaaaaacacagtcccttgtgtcctactatatgacccaacagaatgccaattgcatgctcttaggtgattgcagagcatcctttggttatatatatatatatatatatatatatatatatatatatatatatatatatatatatatatatatatatatatatttgtagaaacatgaaggatacattcaactgccttcatgaaaatgttatgctcgtgattctgataaatacgtgacacttagcattagcataaaataacctgtcaatgctacctcatttttccgttaatttctttggtgttattcttcaactgtttttcaatttgatttttcctcatatatgtcacataaattaaagcaaataaaaccgaaaagcaagagagcaagatcagaagtcgcaaacacacgagcagagatggcagtcggcaaagcacgttcataacaaaaaaaaaatgcaggtagagatgaggagagagagagagttacagtgaaaggaacgaatggcaggcgaggattccatgggaagaaatggaaatggaagaatgggagggaaaaacaatggaggaggagaggaacttatagagaagagagaatagccaagttgagttaagcgaatgaggaaagaggtcgataaattagttgcactgtgtctgctttgagatttccgcccctctaatcaccttctccgtttcaatctaggaacattgcctcgctaacgtgcgccggtgtgtgactagtgcttccctcctccctcttacagtcttacgtgggacccacccctccaggcaggtaggtttcatggacagccatacaatgaatagttcaaaaagtctaatttagtagtttcttgttactataatttttttatgcagtccacactaataaaaaattagatggttggaaaacaaatcttattacaagttttataggtaaacttgaaaaactctatgttataagacctttttctcactttggtagtagtctcttattcaagttagataattcttcttatcttaataataatattttttttatagtgatacatggatgttatttagtgggattttattatccctctctccacctactctttcattatagtaatgcattcttcaaagagtcaaaatatatttcattacttccaagaataaaccttttaattttggatagatttattttttagtcttttaatttatttattttttagatttaatttggtccttcagtttttcagaattcaatttaattctctaattttttaaatcgatcaaatttggtttttcaatctaaattataagaaactatattttgtgatggtttaaaatcgccattaagtgttcttaagctaccacaaaaagcacatttccaaaaaaataaattgattttaaaaattataagatcaaattgaatcaattttaaaaattaaaatattaaattgaaaaaaaaataaatgatcaaattgaacataaataataaatttgaggattaaaaaactaatttaacctttaattttttctcacttatattaatattaaaaaattatattgattttcctaataactccttatctcaattaaaatttccaaaaattaattctagcatcttcaaacactactcaccatgaaagttcatcacaaccatctttctttctcttttctctacatcatgttttcgcttcgcaaactttattgtgttcctagtcttagacgtctgataatcttccacaagtattgaactataacacttattgtacttgcaccgttaatagctaacaccaaatgagacgtgtcacttgacttttatatcactaagaaaatttcaacacattgatccagtattagctccatcttgctttaacacttgtttgactagtcacttaagtgcaacaaccaactttgatatcattgttggaaaaataaaccttattagaagtttcctagacaaacacgagaaactctttccattacaagactttctctattacttgggtatggtggtgacttcctttataatggtggtgaatagctccatttataaatgttatttagtgagttttaattatatcatctctctatccacattttcattacgctagtaggattctccaaaaatcaagttacattccattttacgtcacctcttaattttttgctcagttgctttaatatttggaaatttggattggttttcacaacatatactagatataacttttaatgtaattcaaaataacaattcttgataaattgattttcacaacatattcatatatactcaaaatttaaagataagtactacattttatcaggtgggtcaacacattttacctccccgatcatagagtgatcaagaggaaaaaaagaatgaatgaaaggaggagtaaggtgaaggaaagtaatgaaaagaatgagacaacttttaaaaaattaaaattaaggataataaatttatttattgaaataagggtttattttaatcaaataaccaacttttttgtttttttagtatgtttgtctaaattattatttttaaaaaataactttctgtttattttaagaaacaaaacaaatcttatttgcttttttaaaaaatacttatataaaaatatttatttttttttttttttaagtttaaacaaactcatcctaatatgaaccagaaaaccttagtttttgttaacaaaaatgagttaaaataattttggattcattttaaaactatttctttgtctttttagtcattcaaatgatttattgataaaaaaatattcaaatatttttgttttcaaatttaagtgaggagtgataaaaacactttttttattggatagaatttattaaaatttacaaaaatcatgagtgaagttagaatgatacatacatattttgtcatttccaataatttttagtgaaaataaattgtattaaaaagtgtgttgctatttttagcactgagagtcatgaacatggatttgctccaggagtgataatttgtggaatcaagtgagggagaaactcatttttcaatttaactttaaaaaccaaaactaaaaaacttacaactatacattgtattaattagcatgtgttttatatatatatatatatatatatatatatatatatatatatatatatttgagtatggaaggagtactctattcaatgagatgaatatgtgttaacaaaaagattgattaggcgattaagaaagaagagagattcaattcctcttactactaaaatctaataaactgataattaacatttgttaataataaaaaaatgaaatggacatgcaattaattaggccaatgataaagaatatatttaaaacaaattgttaaatacagtgtgtttgacaatgatatataatcgtgtccatggatcatatcaacctgaaactaatgaaaggatcacagatcacttctatcttccaattaaggaatcacaggtttaaacaatagtagtagttaatttgcacatcactactctggaggcaaggctaagcaacgtcgagatggactatttctcgaaactccaacctcctagtttcactgtagaatgtcacacattttgttagaccaatatgttagccatatccaaccccttatcttccattccgttgttttccctatggctcctttgttcactttccaccacactttttttccatattcatcacctgcgaatataacccatccttccttgttgaaaggtcagtaagcactggagtatcgatttttgaaccatgactttgggttaagcattgcaaacttcgaaggctttgatgataaaacttctttgccatcaacgctgtcatgaagaaaccaattcaaatttgcactgtatccataaactaacggttgaggactctctccagctgacaccttaagtgccaagggattcgatgcctcaaatgaagcttctacgcttttgtcaacaccaatttcttttcgtgggttctctgaggatttgccaactgataggctcaacacttggtcttggattgtgggtgtaagttgcaatgatattctggaaggaaaatgtttttcagctgcaccagcccctcgttgtttcataaggaactcattcaccaattcgataacatcacacctgtccacatggaatattgtaaattatattggagattaagaatttacgttaaaaattaagagtgaatttgtttaaacttataaaaattaatttaaaaatagatatttttttatataaaggtttttttaagaaataaataagatttttttatatattaaaataaaaaaattatttgtttaagaaaaaataatttataaaaatgttttaaaaaataaaaaattacttattttattaaaatcaatatttattttaacaaataactttaaataaattgaccctaaattgtacacaattaattaagaaaaacagttactcaacatatatatatatatatatatatatattacaatcttatttccttaggtgagatgaattagatagatcacatatcatcatgactcgattaataatctccttaatacagtgaagtaaatatataaagataatgcgattcataaaaagagtgattttgatcacctttgttataaaaagaaaaagaacgatgctttttttttttttgtaaatataaaatttaagtgacttttagatatttccaatctaaatccaaaatattgagctataagaaattgagtttaagttgaacaaaagtatatcatagaaggaagaatttagagaaaagaaaagaaaaaagtacataccacaccttgtaaacaattcaagctaatgagcccaaaattgtacaaatgatgaatttttttttcctaaacttctaataacaacatgggcataagctgaataatggataatttatttgtcttgttaagatgcttatttattggctctatatgtattatctcttaatgggatattaatgggataatattagtggttaattaattagtggttaccttacgttgtcaatgtccaccatgatttcagcccactcgtctttgattaagactttgtgattgaattgaagaacgccttccacatggtgatatctgagggagaattgaagcctctcgctagctggactgctttttgaattctcaacatccatgaccatgaggtgacaatacagctgcaccttccacaacccaattgttgaaaatgcataagaaaacaaaggacacggtgttctgaaggggttgttatgtgcttccaagttccccaacccagttactgaccgcaaggttcaatgaacgcatccacagctcttccaagttagaccctaagagtttcataatcatatgtgatgcttgtctagactgaaaacctatcaagtgatctttcaagttactaatgcacccagaacgaaaatctgcagcaggagcttcatatatgtaaactaggaacaagagggtgaagaaagaacgtctgaaaggttgaaaacgtctgaaaggttgtcggaagcagtggagtcaaggtttggaaatctgatgaaggtagtgctgtttttgttggagccataaagaaggatggcctgaatgaaattagcaaagacattgtaaatggtttcttcatcatctattaacttattattggtgtttttagtagtgctgctaattggcttgaaaggttttgaggtctaaagatggatgggaatgttgcagtctgcaataatgccaagatagaggtttgaggaatgactattctttttgtgtacggtgagattaagacgtggttggcatgagcttgaagaagaacatatgtttaaggacatggaacttgtttcccattctgaaattggtggaaggttctgaatccagcaaaacacatcaagaaagttgttagccatggatcgaatgaagcaacttaattaatataactctctctctctctatctctctaattcggttgcattcaggtgtggcttcacatttatttgtagactcttacataatgctatgttatgtactgcaattagcaaatactctttctagtggagaaataataattaaaaaagtggactgattggtacgaccattagtttaattagctccatggagaaaagcaagataaaattgctaattattggttaagaaaataattgcaccagatatattatataaaatgtcaaaaacgcattccgtacattataaataatattatatacgtcatatttacatcattttttatccttgtttatctcaaaaaagtgtaaatatagagagagtatatatcatatcatataatatgtaagtttttattagtttaaaaaaatagcttgagagtaatgtgatttgtcatgtgctaataaaatatcattttgaatgctcttttatccacatatattaattgttaatgattgaagtttattattattattataatatccttttaacgatgaaagtttgttttaaaaaaatatagatttaagatgtgtttggaggaatttatttatatcttatctgaacttattttatggcatacgtgtaagtatttaagaaaacttataaaattatagtttatgatttatttataaattgttttcaacttattttaataaaattttcaaaataacttataagaacaaattaaattttttatatgaaaataatttaaccttattttcttttcaattataaaaaacaatttacaaataaaagcttatatatatgatacacacttttaagtgtttaagtaagctatctaaaaaaggccgtacagtgtttctttaatgaactatcgatcgggaatgttatatatggaaatatatatacttgagtgaatataggctcgattactccatagtacagtccaataattattagtaaacgaattatacgtttaatttgtatctatatatcttttgttgataattgatgtaatttcaattttaatttaccaaagagagttagcaccacagcgagcatccgttgcctcattagtcattagtacttatcaccgacatctttttgtttgtaaaaggaccactgattcatttacctacatatataatatacaatatgtatgtatacaaaaatcatagtaaggtttaaatgtaatgcttcatgaataagatattctgtgttacagattaagattcgtgtatgataaaatgtttgttattattagagttaaccggcaatttgttcatattgagtctcattaattaccttcttttcgcatgttttgttgacatcgagagtgacgatcctaccgagatagataaggatatatagtgataacaaattgagataaaaagctctttgcacagtcaattatgattaagaaaaatatcaaatcagttttacagaccctagctcattaggcagagataattacatgcacgtaaagaaaaaattattgagtcactaaaattgggatagcgaggaatttgagtaatttgaactaagtcataagtttaaatcgtatcgttaaaaaaaatgtagtttttgttactcttttaaatgctagtatttttattttgaaaggttttaaataccagtattattccactaataacctgcctttatttctttatataaagccttctcttgatgaaaatagaatactaattaaataatcgagaaaaaaaagatacaaatggagaacaaattatcatgaaaaaattacacattagaaaatatacatgttttagcattgaaaaatacaatggtcaattataaaccaaagaggcctaactaagtctaatgtttacgccaccaaatttttggttgataacgtttaaaagtaatagctagatggtctctttcaaagaaatttctgtccatattattcaggtttcaaattttgtttgtaagacgaggaatttgggatcttgatgataagaataagacagggtgaataagttcatttaattaagatggaacgtgcgagtttaacttgagttacgtgtaaggtttcataatcaagtgtacatatgtatatgtattagggtagattaatgatattagctatcaaatttaataaaatgtatatttaatattatttttttatcaacagtaaattttgttaatttaacagttgaatttaaagttttcataaaataaattaaaccccacattatttcaaaaagtaattaatactttgttactacactcttaattatatgcataatgcatcatattttgtaataaaaactttatatttacacacgtatgaccattgattaacctacactgtggcaagtacaccctcattttctaacatttataaataaaagtttttttaaacagaaaattatgataaaatcttataattttatattttatttcatttatatttatatatttattataaattcctatatttatatatttgaacccactcattttactttttataatttatccacattgattcaagttccaaatctacacccatcgagtgcataaattaattggaatatgttttaacttaatcaaaggtcttgagttcaaattttgaatatggagttacttacatatttaaaggaagagtttgttatccataatggttccataagactctcgaacaaaattacttccaataaaatatacatgtggtttataaaaaacaattccatcaaaattttccaaaaataatacaaaaaggatacaaatattttttttaaaaaaataattcatttattttgaatacatgacttttatatatatatatatatatatatatatatatatatcaaccgggacatagtaattcaagactacttaatgttgttcacccgtgatacatgttaattcaatattacacaatcattatcaaatttaattttagaaaatttaatatttttctccattagcatatagtcatttttattggaaaataaatttgatgaaacatatcatactaattaaaggataaacattataatttataaaagcattcaactatatccattaattgtaaagaaaattttcaattgagaatcgaagttaataattatcaaaataattcttgcttttatttatgaaaatatattgtgtgattcttaattattttcgtaaatatataaaaatgaatatcatcatatattttgaagtaacttaaaatatatttaatcctaaggttctacatgcttgaacaaacgtcttcatcacaaatctttgtagaaaaagtaaataagacactaccaaaaaaaaaaaaaaatcaccaccactacaaataaaaaaggtacgcaaaaagagaggttacactattaccaccctacacactgtcttttatccacatattccttctcaatcggtaaaagaaccaatagctatgatagacatccccggccggactcgatattttttcaaatgttccctcaaatcactgttagttttgatgttaaaacaatttgtttcttggttttgctagtgaaccgcttgatttcatatagcaaaataagtttttttttttttttttgtaggctagaaaaataagttgcagtagataaaaataaagacaaagcattctgatcgctataattgtaaccaatgtgcaatattaaagaggtgtctgagagcatacaatatcattttgtagtcttccaatttgggttatttctagtgtacacacctcaaccttctgtgatgacagccttttatacccatttcacttaatttgcccatgttctctgtccactcgtttgatgtcttctaagtaataactatcagtttcattgaccttgtggtcataactcatatctaccatccttgagctaacacaaagaataaagagatatttaggaagataaaattgtgcgaaagtaagaaacattcaattgtaatatgcttcaacaatagtatggccaacagtagtggcgaatctaagactctgactaagcagccataaattaaagaagcttatttacaactagtgttatcggagaatgaaaaattgaagaataataagttcagctataataaactcgagggaggaaaaacaatgaaattcaagataaatagatataacttattaaatttaaggggtgtatttgcacaccctgaattatagagattcttatatctttgagaaaataattaaattgggaaaaaagagataatgactgattgagatttgcctcagaattgttcgttttaatattggtacgaatctaatggttttatcctgaaagatgctcacaagaattgagggactaataaattgtttataaactactactaaatgagatgagactttaaggtgtactgaagcaatgtcatttaaaaaatgactactcgtatttgtgttgagaaaatttattttcaaagaaaagaaaatatatacatataagataaagtaattaacataacgaaaggaaataaaatgcaacattataaaaactacaactatataaatggtatatacaactcctagcacatgcattggattgtgaattaattaaaatgttgtatggatggtaaaaattcaaaactaaaccccacacaatttagtgacacagaatataattagcgttgttctttttacagaaaacgacgagaacaaaggtgtcaaaggaaaggagatggatgcatgtggtatgagctcatccaattccaaacatgttgtggaccaaaagcgaagtaccatgaacatgatgatcacgacgattcttctcagattttgggaccgctatgatatgaattgcgactacactactaactcttacgagccggggtcatcataaaaccattaccatttaccactcttttgaacgttaatgtagcctaaatcttatatccagagaaccagaccctgtttaaatttcctttttaaaatgtttctgataaatttctcttgcaagtgtctcagaacccagttagctccttcctcaccacgtgacacttcagtgaaacttggagatgccagcaggtttatttcagccagggtctttgtctctcagggcaattcattaatttaaaaaataacatttttttatacatattcatcagtgcacgaggaggagggatagtatgtatcacactttttaattcactttctattgttttctgttagttgaaattcaaatatccctcactaatttgagactgaaacatttcaccaaaaaaaaaaaaaattgaggatggaactttcttttttagttgatcataaattttttcttctaaaatatataatgtggatacatattttttgagattgaaacctaacaaatgataaataagactcacttatttagtgagacatacatgaatttcagagaatattttcctatataggttattagcatttcttttaatattttttttattattgtcttatttttaaaaagttggcattctttttaaaattgacttttttgagatattgaactattttaataataataataaaattaagttatatagtgtattaaaaagaataagataaaatgtgttttaaatttctcaagactttagtcaaaattagtttcagtctcctctattaaaaatgtgttttaattctcatatttttaaaaatatggtgaatttcatttttaatcttgaacagttctttaattttgacttaattaaattcaacatatttcagaaacacgggaaccaaaaccaccatttttagaatccaagactataagatcttaatgacgtaaaacacaatttacccgtgagaatattaaagctagtagtattgcttttcagtgtgtttcctacggcacattgttgtgtgtggaagtggaagctagaaaacaaaggcagcagaagaagtatggtcctacaaagtgtgtagtagtgaagaagaaatagccgttggtggtggagaggcgcgggtttgcaataaaagaacagcgcgccatgatcctataataaaccctgtcaacaaaaacaagtatgcttcatgaatagttactatttacaaggaaaactagccgttactcactttttcttcttttttttttttgtaacaaattctgaaccctgcatgttcattctctctctctcacgctcgcaacccgcgcgcgcacctacacttcttttatgtcatcacgtgctccttctcactctccctctctctcactacaaaaaccattcttcaacttgcaacacacgcacacacacacactcacacacactgtttttttgttccactaaatcaaaacctcttatctcttactctcattacattcattcttttgattttcgttatggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctaagggacaggttattgtgatccagcttccttggaagggtttgaggggtcgaatcaccgacaaaattggtcaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctatctaatttatcctcacttacactgctgaatgcagagaacaacctccttgacaatcaaattcctcaaagtttaggtagattgcgtaatctttctgttctgattttgagtagaaaccaatttagtggacatattccttcaagtattgcaaacatttcctcgcttaggcagcttgatttgtcactgaataatttcagtggagaaattccagtctcctttgacagtcagcgcagtctaaatctcttcaatgtttcctacaatagcctctcaggttctgtcccccctctgcttgccaagaaatttaactcaagctcatttgtgggaaatattcaactatgtggatacagcccttcaaccccatgtctttcccaagctccatcacaaggagtcattgccccacctcctgaagtgtcaaaacatcaccatcataggaagctaagcaccaaagacataattctcatagtagcaggagttctcctcgtagtcctgattatactttgttgtgtcctgcttttctgcctgatcagaaagagatcaacatctaaggccgggaacggccaagccaccgagggtagagcggccactatgaggacagaaaaaggagtccctccagttgctggtggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagagcctattacttgggacccaaaggggaaaagcttctggtttttgattacatgtctaaaggaagtcttgcttctttcctacatggtaagtttcgtgtgctgttctttcattaagtgttgtgtgtgctgttctttaattataatttggagttttaccttagtaatctgtataattctaatcggagaacagtacaaacaaaaacacctaaggaacactatagcacctaaggaacaacaccttagctttaatataccatatcaataagtgaattattttcttgttcatcttgatgcaggtggtggaactgaaacattcattgattggccaacaagaatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgtctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatagcacaaattttgcattgatttttttgtgccaaatgtagtaggcctactatatatatgttctatgattctttcattcttatattatttttgcctgtttgaatgcttgaatttgtacatactcatactacaataaggtgtagttctggttaattttacctctacctcaaagctggggtgtaattctgtttcctccaaggcacataatagttgaaaatagttctcaggagcattcattgtttattctgcaagattctctttcacggctgctatcttctatgcatgccctgcccataaatgcattatgaagaattgtaacggctgtgtttttggacttcttcaaaaagtttatgttattgccaggtgtatatatcaacatgttttaaagattttcaaacaatcaggttttagatgtgggtttgcatgcatgagattggactagtgcgcttgatgtagtataaaatataaattgtccaatcagcaccctctacatgtccaaataatgggccttatgaaacttaattttttaattacaaactacagtaatctttttgaataaagatttacaaattacaacagacatgtgaagtcgtcatctttcattgccaattctttcaagtttactactattattttcctgcaagcattccacattcacatctgataactatgacagcatcttccaagataatgacttccaagttccaacactggctctgtacatttgaactaattttatatcatttatctattgtgattgaaatataaaattgaagtgatgtgaacaatacaaatcacatcttgaattaaaatatctaacaactggaacaaataagaggcccagaaaaaagggataaataacggataacaagacagaaagaaaaaaaacccaacataattccaacttcaaaattcactcaataaaaagtttaacatgtaaatttacttggaaacaaaactcataaccaataataataataataaaagaaatcagttttatagcattaatttgggatgctctgcttgtatgcaaatggcacaaccttaccctcaagattgcaaaacacagatgagtaacagatgcaatgtgaatcaataaaaagtattgttgcgttgttgatgacacaaccttactcataaaaaatgcattgttgatggctagcattgttgcaaggtattcatacagtttattctgcaacatagagaaaatacaactcatcaacaccaggaaatggttctgttcaaaatcacggattataaaaagttattatctaaatgttacaagcttaagaagatctatcattgtgaaagtctcttatgcacattaatattacaagcttaagaatgctatacaaatgtttgaggttttgatatttaactttttatgatatgctttgatttaatagttgcaaattgccacatttctcatgtcagttactcgtattctcccataaataaataaggcttcttctgtctcaatttattttacttctaaagcaacaatttctttctttctcattttttttgtaccctctgatcagatcgtagtccgatcctcaagccttagcctctacacactttgtgctcgaggctcgatgattgtatatgcttctgaccggactgtagtctaatctggtggtggatcccaatctgatctgataacctccacagtattgtgcacattataacactgacgtagggttaaccatgtaccgagatccttgggcacagcatcttgatacgctcaattggcctcgattcctgaatatcggagatgggagagtaggcaggtcgcaataaaaggtcataccattaacgtaggatggtaggttaagtaataatacccttgacttgatgctctcaactaggtcaccttgacatacgacaaagccttttctaaaacaattttatacattgaaatttggaaatatgtatgcattgaaattcacaacaatacttttctaactcatatccaaatttaagatcagcctaaaagcccaaattaggggatgcaaagaattctatcgttaaatcaaacacatcagtcaaaaaagaaaacatacataggcacaatcaactgatcaagtataacagtatttcagatattgttagcgactagaaggtttgtatttaatttgcaaaatttaatatgaatactactggttctatttattttataaactggtattagtaatgaaactttaaaatggggaatattttagcaaaaaataaaggttaaaatatgtctatgattcttaatgaatattccaattttatgtttgctttttagtataaaaaaattccgtttttgttccttgataaaaaaggaaatttgtttttggttttaaacactttttttagtccctattaaattacgaatttcctatttattctttgataattttttgtttattattagtcccttcaaaaattactaataataaatattttttaacaggaaataaatacaaaattctctaatttattaggaattaaaaaaaatgccaaggacaaaaaaattattattttattaagaattcaatgcaacaaaaaatttacctaaaagcaaataaaaaatttgagtatttcttaggaattaaaaatattttaataaaaataaaataaagatccaaatgatagtgtgataaccgaagaggaatgtctttcaaccactgcctgaccgccaccactgccaacagcctagtatcaaccgaatccacatataccaacaatcttcagacaaacacttctaagttggtgctgaagagacaatatctcatgggtagatcaaattaagagtgctaccaataacaaaatcgggatcatttgactaacaaacagttatgtgcattggatgttctaccatagtacattgctttatgtgaaagtcttttaattattcaatattgacatgttcttatatatatatatatatatgagggattgtattatctctgaaaaaagattttatcataaaatcataatgatttctcataatgtatctttacattttaaagttagataaataaaattgattttaaattgttagatataattaaaatacataattaatatgacttttaacaaattgatatataaacacttaaaaaaaagtttcatgacgtacggtgtgtattgttggtacaaaaaaaatttatactatcaactaattaaaattattataaataataaaattaataaaaattactataataatctgtaattagattattgtaaaattgttttataatataaatatacagtcttttttctttaagaaaaattgctagaccaagcaatatggaccatgtgctttctgaaaatatataacacaaaaattccattaagtttttttgcacctataagctacatccgctacgtactgcatgtggagcctcatgagtgtgaggatcttccacaggtcactagtttgacatctgaaagctcctcgtgtaaaacgtgaaaacaaataacaagcttggactggtgtacgatttagtgttactagctatcccatgtaataaatatataaatcttgaatcacaaggaatgatgcaatatatggttcctctaatagtaagttatcccaccaaatctgaatataattaagaagttgtattcgtctgaatgttgtgtctaaaagggttgattgatgaatgatggctacatgtgagagtttgataacaacagctagctagccattagccaagccactaactagacattagttttggttggttgtcagacaaaccgttagacctgagaacgaaagcgtattaaacaaaagatgatatgtagacttttaatataaaaagagatggagaaaccaaattgagatttgataggtgaactataaatcatgacagtgcattagacaagttggtagagtttgttactaactcatcagattcttaagaaaggcaaaaatagaaactacaccacatgtcgctagcgataacgtgcaatttataaataaataatggcttcattttcatggttagttataaattaatgggtcacaattcttaatttattaggaacgtatacttcattttgagagtgtataaagttggaagaagaaaagggatatagaaagaataaaaaaatggatttatctaattcatcgtaaatgaaaatgagattaaatcattcaatcttcattgaataatagaatttaaaaaattgtcttattctgaattgtatcattaatattataactatcatatttaatgtattatctttcttatcatttatgtataaaattaaaaatttataattaaaattatattaaaatacataaatatatgtaatagaattataaaaattaaaattacagctatatataatttcctgtcacttagacttgcagtagacaattgtttgtagttaaaaaatatgaactgtagtccggctacgactattaatttcaagacttatttaacagttaataataattttttgtcatctcgtccccatttgtcttgcgtgttaatatatgttataaatagacattgatatatttttttatgtgtatttgttgatacataacaacaataggattgtaattcagattttaatattttattacatgtttatgtattttactataattttaattaacaattataaagttttaattttatacagagaaattaaaaatgatacattaaatgtaataatcataatattaatggacagaattcataattagacaaatgtttaaattgtattggttattgaagatgagattttttattttcatttttacttggggtcttagacaaacctaaaaaaaagagaaaataacacatgtaataattaagtgaagtaaatataatggaaaaagatgacgaaattaagatgagaagaaaatgctatgagattgaaaagatattaagtgtctctttatataaaactcaattaattacgagttaactggtcatgcatgaaagtgtaaaacatttttatgttatcatttaattataaattatagttaatataatttttaaaataattatcataaaaattaataaatttactgtacaagatgaattttaattaaatagtgatataatttttttttacactaacaagtgtataattctttatctctttaattattatctaacttttgattccacggcatgtcaatattttctctctgaccaaaataactatcaaggttagtaaacgaatataaagacaaatccatcatgttcttttgtgtcaaaatgaggccttcttaaagatcacgctcaatgatatgtagttttctaagtcgctaaaatgcatgttaccctcatgaagctataatagggttcagagatagctttagaagttcaatagagcatgtggacctgggagtgaggtcgtatgtcgctataatgctgtataaacttttggtgagcatgcatgaccattttactactggggcttccatagtgggtttcagtgatagtcttcataagttcattagtctttacaagttcaatagagagaatatatggggacctcggagtgaggaggttgaaagtcactataatgctgtataaactttggtgtgtatatgcaccatctgatggccatccaatgtcccctagggacaacagggtacctaattaattggtaccacaacggggagaaaatcaacacgtttgtggaatatacatacctagaattgaagggctagctcaatcaagctaaacttgaattcaactatagaaattaaattaaattgaaatttggttacacgagtcaggaccattagttataattaaaatgcgttagcacaatttctaacgctataggcatagaagcactaatggtgacacacactagtataaaaatacttttaatatcagttattttagatttttttgtttgtgtaagtcaatcaattttaaaagttacttctaaatcaactttaacaaaaactaatgtagaaatgatctagaaaactttttttttaagttctaactctttttcatcaatgttatacatatatatatatatatatatatatatcccaaaataaccaatcaaataaactacttagtttacttatatgttaaatcatcgacctattacaagagaggaggtctaactcagatgatttattataatgttaagttattttaaatcttttaatatttttatttgatttctatgaataaaaaaaaatcaacttacccaactttaaagtctcaagtcattggatattatcttttttaaatatatatatatatatatatatatatatatatatatatatatatatatatatatatatatatatataaattgaacatttgttgttatattagctaatattgaacatttatttatatcttaaataacatattatctatcaaaataaaatgttataacaaataataattcatttttatttgtatgaattttcataaatttatttattttcaaaaactttgaactcaatgattgtatgaaataatttatattcttaattaatgaattgatcgtatcctatatatgcatagtatatgaaaaatcaattctcttaaagtaacataaagaggccctttcgtttaagtaattgaattacttagacttcaaaaaaacaattgaggggaatcaaacaattaacagataattaattctagcaaactatattctcctatatattgtcaaatatttgaaaattaaaactgtaagttatgataatgatattatagttgaacacgtggcagtatggtgacccaatgttcgtcaaaaatcaaaatgatgtgtgcctggtacagtcaagtacgtatctttgagtatgacattcttgtgcatgtaattctttgctgatcttatccatgtgtaaaataaaattagttatgttggatgacaggccacctagtttaatacttgagaaatatttttcataagtatctctaactaaactcttgttagatgcaatcaaatcactttagttacttatagtactgttattttatttgctcacgcatcatggaagtctacggtacttatagtactgttattttattagcctaattatccatgtataagaatcattgaataaatagttagttttaccagatagaaaataaaagagggtaaggaacacccaacctatcatgagagctaaagcttcacaacaagcaacgaacagcttttaaccttaaactaggctaatgccaatattaaagaagaaataattaaaattgtaaggctggtcgtgtataaattaaacaaaaggccctctattcaaaccttcatatatcatacctgtttttaattaacgcggactactttttcatataaaaaaaagatcattagaggattaatttaaagcgttttagtttttaattaccaaagagaataattattattaggcgctttgtcccacaatcaatcacctaaacaagaaaaagaaaaagaaaaaaaaagtcaaattggactaatgcaaaagtggcacaatctttgtcttgaactctttaattagcaacaaattatactcttctgcacaaatcacaagaataccttacatgaaaagaatgttaatttgacggtttacattaaattatatgcagttttctgcaggtaattaattttcaagaatttaaggtggttggtaattttcaatagctagcttgactagcaaaggaaagaataaagttaaaatgcttcttgttttggcctttttggattgttatactttttgctaaacggaaatggttatatgaatggtaaaggagataaattgttacatagtctaaaattgttatagtcttaatcaatcttcaaacaatatataatataattttattaactattttttataaattaaaattttcaattatatgtcacataaaaaggaattatgaccataaatatataatagtcttaaatcatgtaataatttgtcagcaaaataagagattaaataaagttagaaggaacacaatcagtggattaattaaaacccgtcatataaactaaattaaatatcaaatctcaaagtacgcataaaaaatctcaatagatttttgttaataattaactagtattcttaaaatattgattaaaaaattaaaagaaaaaatatatttattatataaatcagaaaaatataaaaaaattataaataatacaatttttttcctcctaataacaatatttttatttgatgtccttagaatattgggctaacatttaacatataattatacttgggaaaaatttactagaaatagtaataatagattctctaacactttctcctaacatagtctatgattaatttaaatttattgaaaactatgaagttatgagagaattattatttttgtaatttttaagaaatttcaactagagaaaatatgtttaaaagagcctgctgttaaactttctcaaaatttattttcaacctctaaccgcagacttctgaaataagcattcatgcactttattaactagcgggtgcaacaactcctatgggtttggaaccaagttaagtttccctttggggtctgacctcaactaaattaacctaatctgcctaacctcaaaggactttatctttcccccacctctaatccaccctataaaagcaccctctcccactcttacttgcattgcaaccttaaccttcagcattcacactaaggtgttccttgctcgccaaaagatcatggagcctgccaaaaccattcacaacaatgtcaaatactcccccatcttcttagccatctttgttctgatcttagcttcagcattgtcttcagcaaatgccaaaattcacgagcacgagtttgttgtacattctctcactctctttctcttaatttctctggacttattttattcttgttttttttaactcttttccgttagataataattacctagctgttgattgtaatggaataggttgaagcaactccagtgaagaggctgtgcaaaacccacaacagcatcaccgtgaatggacaatacccgggcccaacgttggaaatcaacaatggagacactttggtcgtcaaagtcactaacaaagctcgttacaatgtgaccattcattggtataatatcaagctagcatcttaacttcattttagattatgaagaccctttgacttaattttacacatctgcttaccacgatttatagacatatagatattagtcttacgaaaaacatttttctcactttataattatactactcccttcactcctttttatattaaaatggaaagagtctctctctaccatgtgaaaaataatatataaataaaaacatatatactctaccatgtgaaaaataatatataaataaaaacatatatacactttttacttcttgacattctaattttttttacctttctttctttcccatgatatttatcatttattctctcctctattctcatttatctatctcccaaggtgtgtacattccattagaatgtgaaaatgaaaaacattcacaagcataatgtaaaaaaaataatattatttctcataaccctatatatatatacacgccacataatacgtacgaacgtaagtgatactatcatgaaagttcttgaatggctttcttttcagggtgaatacatatattaatggatagtggtttttgttggtcattgtttcttattattatgtccttaggcacggtgttaggcaaatgagaacagggtgggcagatggaccagaatttgtgactcagtgcccgattcgtccaggaggaagttacacctaccgttttaccgttcaaggacaagaaggcacactttggtggcacgctcatagctcatggttaagggccaccgtttacggtgctttaatcattcgtcctagggaaggagaaccctaccctttccccaagcctaagcacgagacacccattcttcttggtattttaatttccttcttaatttactcatgcatatgcattatttgtaattatagcattcatggtaacatggaggcaactatctaaaaaagaattgagattatttaaaaactaataagtgattgtgatagttgtgattaattaattaatactattgaagcaaagagacaatatatatagaaattgtggttttctgttgtttaattttgcttttggacaaagattaaacggttaaagtgatgatggtgatgatttaggggaatggtgggacgcaaaccctattgatgttgtgaggcaggccacacgaactgggggagccccaaacgtgtctgatgcatacactatcaatggtcaacctggtgatctttacaagtgctccagcaaaggtttgattaattgcttcttaatttcgattgcattaattgaacatgtcacatgtcttgtttaaataaatttactttgcaaaatatttgacataattaaaacaggatatgcagtcataaaaaagagaaaacgacatatgatatgaaattattaaagatgtcaattatttatgaaacaagtcaacaataggttgccttttggtgcagcgtctatttcatggcctttctactttttgttctcttttgaagacaaaagtgtcttccccaccaaataaaaagaaaaaaaaatgcagaagacttttaagtaaatatatagtttataaattgcaagttttagcaagaatttttaaaaaatataatttgatattttttttcataaattagaaagaaaaggctaacactttttcttaaaaataattatattataaaattgtctatttaaaaaaaaaaccattgaaatgacttaaagcgaagagattttatacgcgaaacctgcttttaatgattttatgcaaccaacaaggttgcctgcaagtcaaatggaaaaaaggcatttaaaaacataaagttaatcaaacttttcatttctttaatttagatgatgtatcattttaatttcttacattttcttaaaatattaattttatgcattttcaacataactttttttatatattcaactaatgagaaaatatgataaatataattttaaaataattattgtaaaaatatttttttactataaatattaatttgtaaaaaaatctttacactataaattatttactattcttttttttttacttcacatggattccttcttaaaactttcattttttttactcaaaatctgtaaataaatccaataaattgttttacccttttggtttcatgcagacaccaccattgtcccaatacatgccggcgagaccaaccttcttcgtgtcatcaatgctgcactcaatcaacctctcttcttcaccgtcgcaaaccacaaactcacagtggttggtgccgacgcctcctacctcaaacccttcaccaccaaagtcctcatgctgggccccgggcaaaccaccgacgtcttaatcaccggcgaccagccaccttcccgctactacatggcggcgcgtgcgtaccaatccgcccaaaacgctgccttcgacaacaccaccacaaccgccatactcgaatacaaatcaccgaatcaccacaataagcattctcaccatcatgccaaaggagtaaagaacaaaaccaaacctataatgcctccactccctgcttacaacgacacaaacgcagtcactgccttcagcaaaagcttcagaagccctagaaaagttgaagtacccactgaaattgaccagagcctcttcttcactgtgggtttaggtatcaagaagtgccccaaaaacttcggaccaaagaggtgtcaggtattggactattcacctaattctattatcatgcatcaatttaatttgcatgtacgtatcttatcttaagatttcaataaatgtctcatataggaaaaattacttatttatgtttataatccccacaaattttacattttaatccatactcttaaaaattaagtctaatttaatttcttattctttaaaaatgactgatatgttctgataccaaagaattcaaatattaaatatttttattttttgtctttgtattctattttttcataaattctaatcttgctaataatttcaattcatattaagatcggtaaatagaaaatctagaaaaaaaaacaaaaaaagtatttttttttcattgattttattttcaattgatttgtcattaacaaactgattcctcttaaatctcacaaaagtacatgtcgatataaatatgagattataaattcatgatatctattttcgatttttacatataatgttttttttatcttttttagttcctaataagcatttttaaatgtcttatgttcctactttgcatatcagggacccattaatgggacgaggttcactgcgagcatgaacaacgtgtctttcgttctcccgaacaacgtgtccatcttgcaggctcaccacctcggaatccctggagtgttcaccactgattttccggggaagccgccggtgaagtttgattacaccggcaatgtgagccgttcgctgtggcaacctgttcccgggacaaaggcacacaagttgaagtttgggtcgagggtgcagattgtgttgcaggatactagcattgtcactcctgagaaccaccctatccatcttcatgggtacgatttctacattgttgcagagggtttcgggaacttcgacccaaagaaagatacggcgaaattcaaccttgttgatccacctttgagaaacacagtggctgtgcctgtaaatggatgggcagttattcgatttgtggctgataacccaggtaaataaatagggtcttgttaatgggcgtaacattagttaggaaactaaatataaaaaatatttattgtatatgatataagagaatgtaaaaaaatttataaaaaacaacttttcatattttaataaaaaaaatcttttaatttcttaatcatgttctaagaacacaaattaatatttaactagtaaatattcactattgagttttaattagataacactctagaaatattatttatttatatatgaatatatactttctttccagttttcatttgtataatgtcctttttataaaaagaaagaaagaagcaaactcaatcatttgatgggtgtgttaattgttaattgtaggtgcatggcttttgcattgtcacttggacgttcacattggatggggtttggctacggtgttgttggtggagaatggagttgggaagttgcaatccatagagcctcctcctgtggatcttcctctttgttaggatatcatttcaaaatattcgttggcccccaacaatcggagttttgcagtttttcttagtttggaagctggttgatgcttccctgcattaattttgggagggttttttgttttgcttcattgctttgttttaattgtacgttctttttctagagagagataaattgggtttggaacctaggagaggtggtgatgatgcggtttcaacgcaactataccatctgaacagtcattgcccaactagttaaattgatgttattttccccccatagctcaagttacaaacagattgcaagttttgaatatcaatatatcagctggcttttttttgggttgcaactcttggtctcttgaatataaatatgttgacatgtattaagtttcaaagtcccctaaccatttgccatcataaactaatacaaaattctcacattaattcacagtatagtgtatacagagggatgcttatcatagcatcaagcattaaaatccctcaacgaatgttgtcaacatatggattatgggataaaaatataactacgcttttctgatagagggtggcttttggttttcatcaggctgaatgtgcaagctgatagaggagtattaagatagagtagactattgtaattgagaagcagaaagctactgtcgctgatcatgtgagtgggtggcaaatgtactagtccagtagtcctcttgagttttagcccaataatctcatcaaatgaatctctgggcctgcttcattaatgctaaaagttgcctcttcggcctatgctttttttttctttgttaataaagtgatgaaaataaaggatatattcataaactttatttatgtttactttgtataaatttcttaacaaatacttattgagaaaaaaaaatcaaacttctctcataacataaaattaacttgtgcatttctaactttttagaagttttcttatttaacttccctaaaaaacattacatttgctacagtaacttggtgacagatttcatgttagctctcgcatgatttcaattgtattacaacatttgtactctcagttatccttaataaaatgatatgattttccttgcctaaaaaaaacttggtggcagattttgttgcatagattaattcatctatgtgcctttaggcatttgctagtcatgatggtctataaatgcagtctttacatgtatatttctagattttaacattgttgggttctgtactatcttttggggtctttatttggattcaccttgtgcttaaacctaaaggctattgatcattttattctttttctttttgaatttttttcattaaagttttttctttttataagttgattttaatttttagaagaaacttaattcattttctctcttctttttcctcctgatgaaaaattattcaaattgacttttaaaaagattgtatcatatatatgtgacattttctttttcattattttttatgttcatgtcacataaaatgcaagtctcataaaatgtggttgtaggacaaaaagtgatactatactccacatggtatatataccaaaataaaagtaatacacggaatcatgtgaagcctactcaagtagatgtgcaaaatcttgtgaattcaaattagttgtcttgtttattcattaccttttcaatttttttaatcatcataattaaggcctttcgaatccctttaagtgataaaagaaacgtgcaattatgcaacaaataaattttcgttatgttactatttagtcaaggaggaaaaaaaagtgataagggaagaaacaagggatatttcctgttataacaaacttaaaatggcgactattttgacgacattgcaaatactcatagtacgatataaattttgaatttaatatacaatgaataggcatattcattttctaccccaaaaaagcatactcatttatgtacatttaattttctctccatagaggaattaatgtacaaccatgcataagggatgagcaaaagggacagattattgcaatccagaagcatccaaggaaagttggataaacaaatcaattaatatatataaaaaaaaaacaaaaatgctcctagtaaaagattaaaggaagagttggctatatatggcaaaccttttctaactgttttaccctcttctcatcaccgcattgcatcaccaatacgggaactttcccattacaaaactcattggaagccaacatatcccccaaaattcccaactgatctgcattgtccatgaaatttgacatttcttcttctacaaaattccccatgctatgtcgttttcccaccatcactaggtcatagtccttctccattccccgaatcgctttcaacacttgtatgcaatcttccaccacagcctcatggtaaacaacgttaacactatcactactaatatcattcttggcaataaactcatctattagactctcgtccaacgtgctctctaaattctcatcttcattttctacaagtccattaaacctcgaatcttcattggtaggcaaaacaaaccggaacaaggtgacacgtgtgttggggcgttccaacattcgaatccccaacgccaatgcttctctatcatcttttccaccaatgaagaagataccaacatcaaaagacaacttggagctactcccacttagcaccgagtatctatccactagtatccccaaagtaccctttgcattagcgagaaaatttgtgttgaggttgcgaatggtgctggccaggtggcttcctagggtttgatcattttggtgaaagggtataatgagaagatgcactgagttatcttcggctaggttacaaactgcctcatgcatgcttctgtacggagccacgttaacatacgaaagaaccgttacaggaccacttgagttgttggagtagttctcaaaggcacgtaaaatgtggttggtgttggggtagtttacggacaaagattttcgcttgtttttgttcatgggaagaagaatgggtgtgctttttccaacgagctcaatgagatggaccacgtagacgtacaaggggctttgtgtggtagggttgcatgcttctattagggcaatcatgttgtgcacgtgttcgtctgtgtgcacacatgatacgatgttgaacggtgtattttcggttatgttttggattgttttcacacacccttcttgtatggtttgcgtcttacacaccctacggtgcctgtacaaggatttgatcaagggtatgcaaattgatgtcatgaccaccacagacatcaccgctacactgaatacttctgtatcaataacctgcaaaaaggaacgtcatgacataaattagatttaatatttcactaacaatatgtatagcacccacattaaaaagcatgagagtattgaaattcaaatcgcttcaaagaaattatcatatgacccagaactatcatgtattcttgattccgattgtcaatttgtattacatggcatataatcaattttattatttttttatatatgaaaattttgattatatatatcttgaccgaaatcgtagacatgtagtgatgtcaaatcataaaataattccatcaattaaaaacttacatgcataattaatattttttaattgagagacagaaattgagaaattattagacaatatgacatcatcacatgattatgatcttattcagtttctacatgatatataatcatgtttttttttcttaatttacaaaagaaagaataatatatatgactttattatgtgtcatatagatgttaataagaatcgtgaaaattttagaccacttgatcatttctcgaggaaagagcatgaaaaggagacaagcgatttgatttctacctctcataaaatagaagaaaatatataagagaatatgcattaccctgagtttattcattctaccgtaaaagatgagttcgactatacccttgacattcaatatgagcccaagcacgacgccatgtttgggcttaatattataggtgggagaaatgagcgcacatgcaagtaccttcaccaagcatcccacaaacaagatagccagaactactagaaccacctcccaatgctcatgaattaaggtcaagtctgtccttgtgccaatcaacaagaagaagaaaggcataaaaaactcatacacgatcaattcacttctctctatgattgttgtggcgagggggggtccatttggcagaaccaaaccatagagaaaaggtcccatgacgaaatatatgccgaatgtgtcactaatagctgccataaccaaaggccccagaagtaacaagacaacgtatgcttctttaattggcttcccaggtggtgttctctccaaaacaatgttcactagtggtcgtataataagaagtaataaaacagcaaatccagttgcacctatcaaaagcacgattagaaatcgcatgctgaattttgagttgaacaggagttccatcgtagtccattgcaatatttcactgatcatggctgaagatagagcaatttggccaagttctgtggctacaaggttgagttccatcaaggtttcggatacaacagcgaaactgctcaaggtgaagatgttcgggaagtggtagattgacatttggttttgattagcattaccgttgggagaatacaaagaaaacaaggttacagtgaccaagaaagaagccaagaagggaaacacaccgaatcgccaacaacgtttcgctgattttaatgttgtcaccacgtccattttcaaacaagtgaggaacacgcaatatgtagtgcctattttggacaacgtatttagaaacagggattgtcttaccggaaagagggctcccaatatttcttcatggcgccctaagaatgttggccccaacagaatgccagcctgtaaaatttaaacgaaattaagattatttatgggtatgttggatagaaaaaacaagaccaataaatataaaaatgattatatatgtgtatgttttctttttttgtgggaaaaggaacgataaacttctaaaaaaaccttaagaaaacacgcttgaagaagcgtctgccataatgccgttaaacaagatagaatgatcaaacttggtcagctcgtattgaacactagtaattaaaattactaataaattaacctatatatgagaaatgtagaatatattaggagtgaatgcttacgatgacgcagcagatgaatttgggtgtattgataggcctgaggacataatgaagggctttagagagtaaactgactaaaatgatttggaacaatgtgacaggaaccacaaaatcgaatggattatcacccatccacacgcctaaagagcctacagttctatcattcttgagacaaactatcatttgacccgttctagcgtcattaaagaccgtggtaatggaactttcactcattatatatatgtttgtaccaagcaattagtgttgacaagaaaaacaaaaacctttctctcttgggttgttggtgtttgcaacaaacgcaaacacgagcactacctgagggagaacaaaagtagataggagaaaagcatatatgtgcatttttatatgctctaatcaaattggcagataaaataattatatttaacaaaatatgagctgcgaatgtggtgttagttattacaacggttcaaaaatcaattatagcaatgataactttagtcaaatgtattccgagttggagtttcgagaaattttggctaggaaagaaaattgatatgctatcactgagctaaggccagtgtgtaacgaaaaaccaagaagagtgaatttcaatttagtctctttaaggtataattttaaccaaccgtgtcacaaatatcgcacaacaaaagtttgtgtacaaatgatttaatgaagacaggtgtagtcaacgagaataactggttacaaccaacaatgacatacggaatagtggcagggatgatcggaaaaaaaatacagcaaataggcaatagtaaattttaatttgtgcgccgtttcacgataatattttcttgtagaaaaggattctccttgcaatagaggagtacaaaaagatttgtacaaactactactagcatttaataataaaaaataattttgataacaaaatataaattaaaatatgaaaattcatgcatttaaaattttaagtgttgaaatttccttaaaaaatagtttgattgattgatataatatttctttattttgatatatatatatatatatatatatatatataacgataattgatagtaaaattttacttttacttttaaatacatatataaaaattaaggaaatagtatgtgattaattttactacttttctataatatagttgaaaataagaaataaaatcaagacacgtacttgtttgctattattatttaaattagaaaatgaaataaatattttattgaacctaaagtgtctttaatcatttagcatggagatcatttggaaaagttgttataatttaactagatgtccgtttgaaaaagtttatgtgtatcttaaagttatattattgtataaagtgtatgtttcgaagaacttattaaaataatttataatatatatctatgataaagactaacaataactaaaaaaaactttgcatcacattgttaatcttttacattaatttaaaatataattcacatattttattttttatttattatgaattttaattataatacatattcaaaattatttatttattataaattttagttaaataaaataaacatttatttttcaaattctacaagctaataaactagtattactaaatgcatagagtatgagcaaattcgtgtaggtggattttgtatattatatatgtttttcgttaaataattattactcgactttagaaggttgaaaaaggtcataaaaatttagctattatgaatctaaactttctttctatttttcttccgatccttttgttttttcatcacattagtgatcgtatatgttattttttctcgatttttttcctatctctttattccttctacctaatacactaaaaatgatatatatacatttttccacaaagactcctgcccttttctatcagctaaaattatttatgtacaaataaaaaaggtacaaacacaacatttatttatgaacagataaacgtttttgtgagacattaactgaacctactctatcaagcttattattactactactacttatcttcactccaccacactgtgtcactaaaaccggaaccatccccatacaaaattctactgaagacaacatatcccccaatattcccaatgcatcagcgttctccatgaaagttgtcatttcttttccattcaaagatccatcattgtggcgccttcccaccatcacaagatcatagtttccttccaaactatgcactgcttccaacacctccaccccatcgtccaccgtaatctcgtaccaacaaacgttaccaatgccatatttcatgctcttgaactcgtcaattaacccctcgtccaacatggtatcttcctcttcctcttcacgctcttctcttgtcaaaataattttacaaccacacggtttcttgttcacgataacaaacctaaacaagctcaccctcgtatctgcacgctccgacattcgaattcccaatgccagagcttccctatcgtgggccccacctatgaagaatacacccacgttgaaatacatgttgttgttgttggacgcgcccagccgagagtgccggtccacgagtatccccaacgtgcatggcgcatgcgcttgaaacctagtattcatcttcctgatggaggctgccacgtgtccgacaaggtcaatgttgccgttttcgtgaaaagggatgataatgaaaggcaccatattgtcttgggcgaggttgaaaatggcgtcgtgcatgctcttgtaaggtgccacgttgatgtagggaagaaccttgactggcccacttgagttgttggagtagttttcgaaggcttgcatgatgtggttggtgttggggtaattcacagacaagaattttctgcgaccgtgtctatgttttatgggaaggagaatgggtgcacttttccccacgagctcgataaggtggactgcgtagacgcatatggggctctcttgcactgggttgcactcttctaataaggcagtgatgccacgcacgtttgcttcattatgtacacaacaaacaatgtgaaactctctgtttcttggagtgctttggatcgttctcagttccccttcgaataagctttctgcgtgtactcgagggcgatgcttgtacaatatgttaaccaagggtgttacaatcgcggttataagtaccacacagaacaccaattgactgaatgtatcctcatccaacatctacaaaacgtaataataacataaattagatttgatttgatgtattgtacatacaatgcattttcaatgtttttttaaatgaattagtgcttgagtttatatttcagtgttattttaatccccaaagttatggaagagtcaaataaattttgatttttttatgatttaattcgagtccttcaaattggcgtcttttttctcgttttggttcccagtacttaagtcataataataataataataataataataataataataataaaagtttaggaagaaaaatgagaaaactaattagtttcgggttttatttaaggtttttttagtttcagaaactaaaatgacatatagatacaaatttaaagattaaattcgtcatttactcattttttattagacaaaatttaggtttaagcatgcataccttttgtttcttgaatctagccaaacttatgagttgagttatacccttgatgttcaacatgaggccaagtagcgtgccatgtttaggtctaatgttgtacgctagagaaaccaacacacaggccagcaacttggccaagtctcccgcgaagaaaacaccctgaagggtcaaaaataagcgccaatcctcaagtgcagacaaatccgtgttgatgccaatgtacacaaagaagaagggtagcaagaactcagtggtaagaacttcactcttctccgctagcgttgtccctaagggggggccacttggtacgaccaaaccaaaaatcaagggtcccatgagaaacgttacgcccatcaagtctcccacaccagccatcactagcaccccaagaagtatcaacacaacataaagttccttcacaggttttccaactggggttctcatagcaatcaatttcatggttggtcgaagaacaaagaagttgaagaagacgagcaagcaccagtttcccaacaatgcgattgattttttcacatcaacattagatgtgaagctatgcataacgatgaaaagccatagtatgatgtcgttgatcatggaggaagagagagcgatctggccaagttctgtggctgtgaggttcagttcaagcattgcatcagacacgacggggaagttgctcaacgacattaagcagcttactgagacacgcgcgattgttaaagatgcagaggaaatttgttgggggtgataatagagacataagagtgctaagataaccacaaatgaagcgaggaagggaattactccaagtcgccacgtgcttttggctgctcttatggtcattagtacgtccattttcaatgcaactaagaatacgaaatatacggcgccggttaaggatgccatcactaaatactccgtctgtctcggtggaaataaaacctgccaatacgtcttgttccgccccaaaaatgtggggcccaaaataatgccaccctgcacattttcactagacacaactttaacattcaaactaaacctataattataatttacaaatcatacaagaatgaatttcttctgctagaattaacagtttcaaaccttaaattatactaatagatggttaagatttctacttaaaatcatatatatcatttgctttcgttttcaatgctaaaatgatgtcagtaataagcaacagtaataatcacattcatgataatagtgataaaatgatcaccacagtaatatcaatcacaatagtcaaaataataataataatgaccttgatgtgaaaactgctaaagtgaattttatataaggaaatcattctcatatagaaatgataaaattacttattatgagaatgaaaacaataaattcttatttgaatggttagatttaaaaaatacatcacttcttattaagtggtcatgtgtgaacattaaattacctttaatctttatcataattactcttttcattcttaaattaagattttttttctaatttctagatatattaattatttttttcttaaatattcttacttaattattttctcatcaaatattaatgagatgaatagagaaataagaaaagaataatttttgaatgataatataattaattaattaataaatttaatgtgattaattaaattaattatttttcttaagacacataaattagttgaaaggtaattgtaataagggacagacggagtgaaataaattgctactaatttcataaataaaaaaccttcaaactatgagcaatcgtggtcattgaaaacaacaaagaaatgaaatcctaactttttatcatgagataaattttcttggcaaaatgatagacagaccaaaatggtgtcttccatgtctctcctccttccacaaacaaacgttaccccatacctcagacactcctcgacaactattggacttgtggagtccaacattggactctttgaagaataattcggaacagcctcaactaccttcaatttggaactataaaccacgttatcacactgccttgtcggagaagtgcacctatccagcttatggcgctttcggctgttttccagcggcgagactaacacattaatagttatgtatttcaagggcaaaaggtccaaactctagcgtgtggaagggcgtgaggtggattccatgggagaagaagtctcgcatcatgttgaggaataaatggtgtataaggagaaggctaagcgtcatgtttgaggagactaatttcttgaagacaatttcaagaaaatcatctttgaatatttgatttttaagacagttttaagaaaatcatctttaaacactcaatttttaagatgatttttataaaattgtcatcatacatcttctattatttacaaaattattactgcctaacattttaagacaaatttttaaaattatcttaaaaaatacgttgtaaaaattattttttagtagtataatcatatttgtcactgttttcattatcattattatcaatatttttattgttatcactaccatcttcacctatcattaacatcatcattccatcgttgtcaacgtgagaaggtggtagcttgataccgacatgatgacaatgatgacgatttgtgataattgttgcaaaaaaagtgaaaagaaaataaggggttaaagagagagagaaaattgtagcctttcaatatttttttaaatttattaaaagggaaaaaaacttttatagctagcttaccaggacgttgcagatgaatttgggtgttcttagaggcctgagaagaaagtaaagcgttcgagagactaagatgacggtgaagagttggcacaacgttacaggaagcacaaattcaaatggacgatccccaatgaaaattcctaaagagcccacatttctatcgtcttcgacacaaacttgccactgcccatgggaatcccaataacttgagacaattccattgcctcgtgaagtcgccatattatctctatatatatccaactaatcaaattagtatttctgtgtttgtgtttgcatgcatgatgacgcaacacaaacacgtacccagggacataaaatgctgagtggagcacgcaatgatatgaaaaaacaatgtcttaattttttgttgttgagttatgaagaacaatgtctgaatgaaacaaatgaaaaaagaggaggggaggggtcttagaagctttagattaggaatcggaatattcgtcaacgccaagatataatagccttgcattgcatgttgatattttcgtcaaagcatgagagttaatggtgttacgggggcactaatctaatattatagccactcgtgtaactttaaaaaaatttctattttggcaaaatataatatctatatatggattgagaaattctacttaaaactagcgtaccactaaaattaatctcatacgaagtcaacacttgaaagtttaaagtaactaattaaaggttgccctaacaatcataggccataagcccttagtgggccttgtggtgtgggccattttttaaaaagtattgtagggacaaaaataaccttaatgaaagatgggagtgaatgacttttacacccttgctcatctccatgtttttccatagcttccaatggtgttggacttttgtggtaattctatttggtgttggtcagggaatatggaggcaagtgttcttcttggaaacagttatggggtggtagctcgcgtggctgtggcgggtcttcgtggtggagtgatgggttcggccatatctcgtggggctaaagaacaaaaacaaaaataaagctctgatgggttggaaaggtgtcaaatacactcagcatatttaataaattattattaaaaaaaataccaacaaagttgcaagtaacatatcctaactcttaattaataaaatgcacaatctaacagtttatatttcctttatcactatgaactatctaacaagattcaccatcttaaacttcatcatttgcacgaacaaaagtatttaatttattttatctcataaatttctatgaacctatttttggagatgttatatggtgaacaaaaaatattactaattcactaagtttatgtgcaattaatttttagtggagtcaatttatctttaaaatgagtcaaaggacctattctatggcaatcaacccttttcattagcttctattgttctaatatacaaattttaaatcctagtttttggtctcaaatgtttttaattaaatttgttaaattattttttatttaaccttactaatctaaacatcatggttatatataaatgcaagcatatttattaagataatattttaaaaaaattatataaatgaaaatgatataagatgtatatgaatatataattatttaaatatatatatcagcattattaattttttatatttttaatattaatataaatatatttttataaaaataaaaataaattacaaatcgtaataatatttttgtaagaaaaataataaagataataaaatttacaaatattatatttttaaaaaattgcataaattatttaatacatgttataatattttaaatattcatcacgtttacaaatattttcatcatgtatactaatatatcttatttatatatttaatcaaaatattaaagatgtaaaaaaagatataatcttgttttcatgtgaccgatattttatttcatgtaccatttatcttttagttaattttttataatttaaaaaattaaataatgtataaaaactaaaaaaaaaagtctcagtaaatccggacttaggataactaaaacaagtttttttagtcttttaagtaaatttaaaaaaaatatggttaaataaattctattaaaggtgaccaaatagactttttagcatagattaattattaaaagttgttaaattctcacaccaataatataatgacaaaaaatgttaaattatacttttagttctttcgtatttttaagatttattttgtttttttatctgtcaaaaatcattttaattatttatcttttaaatttgggttaatttgatcctttgaaaacattgatcatttttaaatttgagatataattttgagtattttgtagtcgattcaagatgtaaaatttgtgttactaagtttatctacataaaaattatgaaaatcaattgatgtttgaataaaaaaagactataaacatgataaaaacaacatgaaaagtgaatctaaataaataaaaaaatctaatgtcaaattgtttttttgtttgcttctaagactcactcttttacatattttccatcttatttatgactcacttttattcaaacaccggtcattctttatttagtttttaagtagataaatttaattgaagaaatcccagctcttcaatcaataaaaaaaaggatttaaaaattgtgttccaattttttttttaaattatcactgttttagaagaaccaaattgacccatatttaaaaagtaaatgaccaaaataaatataaaaaataagttaaaggaccaaaagtttaatttagtaaaaaaaatataattattgacgtgcttgatcattattaatatgtttatgtgttatttaaattatagaattggaaaaatatattatatattaattgacttgtttttaattttaattgaaacaattatattgttgggtttttgtgacttagcaatcctattatattataaaaatagttttataatttactttattgtcaacttcaattaaaacaatatgtttctttgacttattgttttaatttcatcaagtatataattgacattaatttacttattattgatttgtattgaatctgatacgtttataaaaagaaatttgcagtacttattttattagtgattaatatcatttaatgtatatatattattaatttgattgatattaatatttgtttagttgatattgtttcttaaaatgacatttatttataacttcgcataaaaaatttaaatttcaaaatgatagtcaatataaacgtgttttatgaaaattgagataagatatccttaatttaggaaactttcttattatatgacttaattgatttgattttaaatgaaaaaataaaataaatattttttaaaacatatatttatactaaaacaaaactagagttatcttctatgtaaatatattttttattatatgttgttagatgaatttgaaaaacacataattatgaatacatagtatgattttaatcctagttaatatatttataagatgaattttaatttgtatatctgccctccatcattaaatcatgggtctaaccctgcttttataagtactcttggagcttgagccctataaccctaatgagtatttgggacccaatgacctaaatattttttttcttctgaataaacattttattcattaaccaaaaaaaatattggtttgagtatctgatcttgcactttaattgcaaatgtccactatggtcaatctctcaaatgagtacgcacaaaatttaaggttttttgaacttcaactctcactctacgatttactccacgcgcggtctacttcatttttatttttccactctcttttctttggtgcagcattgcttgttgcgccttgagttttaagagtatatctcaatagcttatttcaggtaaagattgactccagtttagggcgccgtgcaacatgtttatcggagtttgataggaattttctgttaggctacatgcatatggtagatcaagtttgttatgcatttgaagtttgaattcatgtttacgtttgaagtttgagtacttaatttttgccacgtatagaaagagaccaatggattttgaattcaccatgaatactattttttaaaaagcaatcggtttttcctttgttaatggcacttttttgaacatatataggtgtggttagttatacgaacaaaaaaaaatgattgaaaaaatcaatgctgcttgagttgttacacaatatataaagttacaacgtttccatagtttgcagaaatatgtttggaagagtaaatgttacaattattccattctatcatcattcttaatttttctctcactttattgtggtaaaggggtattgtatcccaacataaacataagttgtggatataaaatcaggtatatttacatgtcagggagattgcattgaaacttccaaaaatatgcatgatatgatttattatatccatgtatatatgtcaagaattagccagcttatcgtgtagacttaattaagccttgatcttgaatttgtattttatagtagttgctgcctgatattacatagtactgcaggtgcacgcaatacaatgatgcatagaaaaagtcatttacgtcaacggaagcatccattccatgcttgtcgtaagtctttccccttcttttcgttaatacatcatcaccatgcatggcaaaatagaaaataaagatcaatggattagactttagagcttatattgatgattttatgatattggagagattgttaatgccctgatccacgtgaaaggacatctgtaattcacagggcatacttcagtgactagttctttcatattatgtgtacccaattggctacaatttttttttcctataatcatacggtgctcacattcattagttttcattttcgtactatattaactccctcaaaattttgtttgaaacagccttcgaggcatatttgtctcggtcatggcgagctgtggagctcataaaatttgagtctggaactacgaccctatattttgtagataatcaccatatgaccattaagaaaggctccttttcagacgttcgagttaggtcaaggaaagctactttatcagattgctcctttttacgaactgggattgacatatgtgttctctcagcctctcagggtaatgacaattcagatgaatctagtgctaatcatgtaagttaatgccttttagttgtagttctatataaaattggatttttttgtctatctcagttactctttatcaatttttctagcgtgtgtttgattaatcttcatggatgtggtagatttagtttgtattcttccttgctgttgattgcttgatacttattagatttttggattattatgacattattgtgaagtatccctaattttgttgataactttcttaaattatttggttggatatcttccctgaaatctctctctcaacaacatttttttgtctgcaagactcaaactcaaaattttccttaaggatttgagtctagtgttactcgatctatcggtagatacttattaattctctttatatgagatgatagccaaacaaaacattaagagaaattaagagcagactctctaacatactcttctctaaacaaactgaattatcttgatttattaatctaaaggattagtttttgtatgcatttgttaggtgattattcatttggcctttcttgatgttgtttttagcaccagtagacctgagttaattctctcctttaattcaagaattgtagtctttaggacattaaaaatctgatcaagtgtttctttctctttttgattttaggtgtggcttgatgctaaaataaattccatacagagaaaaccacataatccagagtgctcatgtcagtattatgtaaacttctatgttaatcaaggttcacttggtacagagctgagaactcttaggaaggaggttaaagtagttggaataaatgaaattgccatcctccaaaagcttgaacgtaatacttgtcaacacaaatactatcgatgggaatcatctgaagactgctccaaagtgccacatactaaattgttaggaaaatttatatctgacctttcatggttggttgttgcatctgctataaggaaggtttcattctgtgcaagatctgtggaaaacaatattgtgtatcaaattttagggagtgatgctacaacctcttcattatacatggattctgaaataagtgttgtgaactttaaagtgaacgaagacggcatgcaaatgcctgttattcatctagttgatttatttgagactgacaccaatacaagcggcgataaacatgattcccactatgatgaagtgccatcatcttatggttttgagggcttacgacgatccaaacgtaggaacatacaacctgaacgttactctgattgtggtaatgtttctgagataaaggttggtaatgttcgaacctggccatacaagttaaacaaaaggaaagatgatgatggtggtggtgaagagtcattgccattagcacaagagaatagtgacaatagtcaaaaggtcaatgaactgagttcttgccgggagattatagtgtaccatgggaggaatgaaacgctggaattaaagtcaggtgaggccaatcaaactcaacttgctagtgttcctcttcttcaagaaggtgattcattagcccttgagcatcatcatctcaatgacaatgttactagaagaagtgatgcatattatagcacccctaagcttaagaggaagagattagttgatctggaagctgatgtagattttgatcctggaagggaaggcataaattccaataaaggagttagcgagaaaagacatggttcatcatggtattcaagaagcagaagccatgctgcagaacacagttataaagacagaagcttaaatgcaactgcctacaaggaaatgatagattcatacttgaaggatgtcaatagaacaccaactacagaagagccacctgtaatggaccagcggaaggaaataggcaactttgggcaaaagaaggaagcagaaatacctgaaagagaggacgaggaacaaatctctgagatcgatatgttgtggagagaaatggaaatggcactggcatcaagttatcttgaagaaacagaggtgtaacaactgattcccttttctatgttgcatttcttttacggagaaaatttagatgcagttccttaaatattgttggtgttgttgttcaatcaaaattggagttttacttagttaatctgcataacacaagtttgcgttaaatgttaacacatattatcaagataaaacttcaattctaattagagaacaacaccaattaataccgaagaaattgccaccaagttttgtccttttatttatatctgtatattctggcttttttatcttcttttctgaggttatttcggtgtaactatctcatcagggttcaaatagtgccaattttgccaagactacggaagaatctaatcgcacttgtccgcatgattacagattgtctgaagaaattggaatttattgctacaaatgtggctttgtgaaaaccgagataaaatatattacgccacccttcgtaagtcaagttcaaaaccatgtttggtttgatttctttaattcacttttcaaaaagcctatgcaactataaacatagttcctcatattgactataacctcccaatttgttcaaaaacctgttcatattggcagattgaaatgcaacgctcagtgaggcaccaagaggaaaagcaatgcaatggaaaagatacaaaggaaaaggctagtaaagatgatgatttccatctgctctcaactcatgctcctacagatgaacataactctatggaacatgataacgtttggaagttaattccccaatttagagaaaagttgcatgaccaccaaaagaaggcttttgaatttctttggcaaaatattggagggtctatggagccaaaacttatggatgcagaatccaaaagaagagggggttgtgtgatatctcatgctcctggagctggtaaaacttttctcatcattgcatttctcgttagctatttaaagctattcccagggaagaagcctcttatccttgctccaaaaggcacactttacacttggtgcaaagaattcaacaagtgggaaatttctatgccagtgtatctgattcatgggcgtggtggaactcagaaagatactgagcaaaattcaattgttcttcctggttttccaaatccaaataaatatgtcaagcatgttttggactgcttgcaaaagataaaactgtggcaagagaaaccaagtgttttggtcatgagctatactgcatttttagcattaatgagagagggttcagagtttgcacacagaaaatatatggctaaagcattgagggaaggtcctgggatcttgatacttgatgaagggcacaatccaagaagcaccaagtcaaggttgaggaaagggttgatgaaactgaaaacagatctaagaatactactttccggtacattatttcagaacaatttttgtgaatacttcaacacactttgcttggcaagaccaaagtttatctccgaagtgcttgatacattagacccgattaccagaaggaaaagcaaaacagtagaaaaggcaggtcatttgctagaatcacgagctagaaaattgttcttagataaaattgctaagaaaattgactcgggtattggaaatgagaggatgcagggtctaaacatgttgagagaaaccacaaatggttttgtagatgtttatgagagtgaaaattttgatagtgctcctggtttacaaatctacacgttgctaatgaatacaactgacaagcagcgtgagattttgccaaaactacacacgagagtggacgagtgcaatggttaccctctagagctagagcttttggtaactcttggatcaatacatccatggttggttaaaacaacctcatgcgcaaataagtttttcactgcagaccaattgaagcagctagacaaatacaagtatgatatgaaagcaggatcaaaagttaaatttgttctgagccttgttttccgtgttatgcagagagagaaagtacttatcttctgccacaaccttgcacctgtgaagttattgatagagttatttgagatgttcttcaaatggaaaaaagatagagaaattctgctgcttagtggggaactagacctctttgaacgcgggaaagtgatagataagtttgaggagcatggaggagcatcaaaggtactccttgcttcaattacagcttgtgctgaaggcattagtttaacagcagcttctagagtgatttttttggactcagaatggaatccatcgaaaacaaaacaggctattgcacgggcttttcgtcctggtcaagaaaaaatggtttacgtttatcagctcttggtaacaggcacattggaggaagataagtacaaaagaaccacttggaaagagtgggtttctagcatgatttttagtgaggcttttgaggagaacctttcacattcgcgagcagtgaacattgaagatgatatactgagggaaatggttgaggaggacaagtctaaaacaattcatatgattctaaagaatgaaaaggcttcaacaaattgaagagaggtatgaaaacatgtgcataatttatgtttatatgtatcctaatcctacattctccgtattagtgttgttaacagtgtttgcactagatcactagaattcttgtcggcatgtaccttcagtgtttgttcaaaatttccatatatgcatgccactttagagttttgattggaaaaaaaaatccaaacaccacataaaattaggcatggcgtgtcgaagacagatttgactcttctctgctgaaatgcaacgcaaattcgagtttagtagaaacttatcatccaaaattaaaattgaaaactttaatacaaatgcacattttggagccattcatgtcatctcttggtctgagtcttatcattctgtggattgaattcatggtttctcttatgacattgttgccaagtaatactactatataaattcagatttgggtttctgataaccgtggtcgttaatactatatatataataccttgcaggagcttgcgcgatacttgaaacaggagcagggacagtggaaaataaaggagccatagcaccatctgcttgcttatgtaatgtaacccaatctgtctatattttaatacacaccccattacgataaaattatgctagggcctaatttgaattgatttctattttatgggaaattttcaactgaaaaaagtatttgaatttaatttacaagaaagtcataaattataatagttatgttgaatgaaaacatttttaaggagttatttttcaaagagaacattttaaaatataatttgtatgttaaaaaatatattataaattttagttatacgcattgcataaactaaaataattataagtttataaatgttaatggagaagttaaacaaataaattttaagaaagataaatttataaatgtgtagcattgtcctacggattttttcaacaaacacacatagttctccttttttggtaattgataagtgttattgcatatattatttatatattaaaatcatatagtaattatctcatttttttatcttttattatttattgtgtcttaaaaccataagaattaacttttgagtttttatctaaaagatgttaaagttaatgattttagaataattttggttgtattttgtgtagagttgtagcagaagcatgaaagaggattaatgaactgaagtgtcacactcaacacgatctcgcgagtcaaaaccactcaatcaagcaagtcatttagcgcaaggagtcacattgaaagacagttgtcacaagcaaacgcgttaagcgcgcatcctgcgcttagtacgtggccacttgatctataagagagttctaattgaccaattaattagtgaaaacatataaaaaggaaaggaaacatttgtttccttaagaatgaagaaaccaaaaagaagtaaagaagaagaagcaagggaaagcaaagaagctaatataaggaaaatccgtttctagagctctagtagccaatctgtttcaatccatttctctttcattttcttccctctcatctcacttttatatttataagtctctcatgataatgaatgactaaaattatctattgttgggagtttttcaaaccaaactctctttagtgtaatgattttaaactatcttttaatataatgttgttattattattcatccctatgcttatttacatatttatgggaaatgtttgtatactaaaaacttatgaagaatatctaaaatgagtcatatctaggatagagtgattttttttagcatgttcatgcatctttgctctgaatgcaaatcatctagtaatcaatcaccaagggattgagagcgatattaagtgatttagatttttttatttgaggaatcttagttagaatagactagtagatgtagataataattatgttaatgttaaatgagaaaaatctattaagattaaatcaagagaagttttggcaagcaagagtcccaacacatttcttaactcatcacaatatcatctcacaactttgagcgtttgtagttgctttgtagttgattccttttaacttatactttatagttgttttgtagttgattccttttaacttatactttataattaatcaatgaattagattggtgaatattagttattgattgttaattttttgttagaaggagattgaacccataatttttttctctttctattctttcttaatcactcaactcattttatatcttcaatttcacgataattaattcttctacgaaaaacgttttcgtaagccttactttataccatactagtttaactcttagaatcctatatttcttcttaaatacctgtttgcatttaattggtttttcatccattcttagatcaaatctccattggtgaacattcaagaatccaaattcaccttgctctcacaccaaaaaaaaagaacatagaggagagaaaaccaaaaagtggtgaaaaaagtgaagaaacacacccatcaattgtcatgaattctaatcaatcccataaatagtcatgcgttcataaaaatattaataatgaaaatagtaatcatatcatcgtgcaatgcattgaaaaaaataggtgagaaagctatatttaaaattgaaaatggagtatacttttgattaaatactaaaaaacatttttaggaacaatataatgaatattgtatttaaaaaaacattccatttgattaaaaaaattgattaccataatatataaaattaaaatttatataatacttaattgattcatttactcaaagtatatattcgttgtaatcatgataattagtataattcggtatttttatgagttaaaaaaagaaagctgtaaaaatgatcagttataaacgatatataagacatgaatattttgataaaaaaaatgataaattgtatggcataaacttgattattttgagtgttttaagatgtgaaatttttagttatactttgtcttgtttttttatatcttttaattgaattaaaaattaaaaacttttctcataccgataagtcataccaatttagggcaaaaacttttctcacaattttaattattattcttttttatattttttaattttattttaattaaaagtgttgtacgatgtacttaactttttttttatataaccccctcatgtcaagttggagaattggattatccatccaacttgatacaggcatacgttccagacctaaaatgaaataataatattaaaaaaaacttgattcagaattatcgatcaattttctttctgatataactaactatatctacaacaattatgttttagtgatgtgtctcaacttggctgttgcttaaaattttctgattaattatctgttttatattactcatattggtatataaaaagtgattatcaccattaaattattttttttttctagtggatacagtgctataccgtgtatctggtattgctttaatttttatagtcgtatatcttgtatcgttatatctcattatattgcgccgagtaattaattaacttagccagagaatatttatatattataaatgagattcctcgaatttgatcaaagcttgattagtcttgtatgtcggtataaataattcaagaaaacaaatatcaagacaggacaaaatcataaaataacaatattgtcactcttttcggattttttttagtgattgaacaaaaaaaattcaaacaaaaacatttcgttccttttaaattatgaacactttaaatttggagtttggatagtaaaatattttaaaacgaattttcactccgtataataaaggactcattttacaacatcaaacaaacaaatatttaaattgaatttttataagagtttaatacctatatatgtaatatcaaagatggtgaattatagttgaatgatcatataaatttttttacataattagtatataattttttttcttttttataaacttatattttttaataaattttatatgtaatgaatttttatcaatttaattattaaattgaaaattttcatgaaattataaacacacattatatagtaatttgacacaaatgattaatgtattaaagttaatgaaacacattacatacagagataggagataggaaggatttaatttgtattattttaataatgtaagtcaaaattatttttacacttttaaataactttttactaaacaattttattataaaaaatattagattgaaaattcctattatacagattatgtttataaaaaatttatcactttaaacatgtatatgtgcatgttggatatacatatagaagatgactaaagataagatgaggtgctcgtcaaaacttctacaaaagaattggtcaaaatattttgagtcagtgaatatgctagtcacaaccctcttaacttgattttaaaaataaaataaaataaaaaacctcttaacttgcttcaaaatgaaacctcttgcattaatccaatcgtgcattgaatgagtataaaatagtctacagtggttagcaacagtctcaactctcaaaaacttgaaccaagttgtattaattaaaaaatatatactgtattctataactgaaaatatcaattggcaataatttaggagcagccgctcccacattcatttactagacagctactattttccttcctctatatttgaatttgaattcttttaaaaaaattgtttttcttctttataagactctcttcaaatattatttcttacgttaattttcttatcaaaatatttttaattattttaaatttttttagtcaataaataataattattataaattaataaaaacaaatatttttttctctcttataaggattgagaaagatgaccagtataaactaataacagaaactaaataattattgttctttcttcatacattaattagttaaatgaacaataattaaatgaaaaaaattgagatgttgagtctcaataattttaaaagtaatttggaaaaaataatgtaaattgttaataaacttaatgttattaattcaattaattaatttttttattcttgttaattggttaaaagatttttgtgtataaagatgaaagaagtaggtattttatcatcatccaaggttatttgattatttttcacttgtgttttattttaatttaaagggtagacggacaatacgggatcgatgaaggttaattattgagttaaaaggaaaaagaaattcaagttggtggaagttggtgagctttgggggggaaagttacgaaagggacgaagaataaagttcatgagaaggaacgaatcattagaaaagtttcaagagtaaaataaacggtaaaactaaaaccaatagcgaaggagataaaaatccataagctaataatatatgcctagttgatagatgaaattagggagaaattcacaggttagaaataggtcagatgtcttgttagtggtttgcatgtttggctcgcattaaatttaataatatctaaaaaacattgatgataataatatctaaatttacactaaataagctaagttaaaattattttaaggcttatttaatgattatactacaaaggttttaaatcatttaagaaatctttgactacaaaaaattagcttatttaaatatataacataataaaatataatatatatacatatatatatttattatgttatattatattatatttttactctaatcttaaaattatatatatatatatatatatatatatatatatatatatatatatatatatatatatgcatgcgcgcgcatgagttaattgaagtgggattaatataacttaattagtgacctcgattctagatcataaatatgcaggtatattaaatattagaataaaaaaattgttgtttataataattgtatatatgtcgctagcaagattgctttttttaaaaaaatgcatgtaatttgctatttcaaaaatttaaaaatgacatgtgatcaatatacattattttttaaaataaaaaaacttctttttattaatgattaaattgtctaaaattatgattatacatttattatttgtatacttttattgactatgttttatggttttatgtgttaagctttggtgtatataattaaaatgagtttaatatttatgtattaatagtataaaatttatcatcattgatgaatggtgaaattttgaattatgattaaataattatataaaaaaatttacatgatgaatgaataactttttttttctcaattaaaattatgatcctttgtcgatatgttttactgtgtcgaccttttttttcgggggagaggggaccagtaggagaagtagtatttagtaaaagaagggagagagaagttgacttatcctttaattagtttagagaaaattagacgagaaggaaaaaaaataggcgaaagtcactttttctttctatctctaccaagaatgttgatgaaaaagtggggagcagaattttaaatttttattttcatatttatccttctccacatttttgttttcttccatttttttataaaatgatttattttagggcatagttaacttttcaatttttttcatttctattcgatcaaataaatagaaaaataattttacttttctttcttttaacctttttcatatttctctcataacgaacaacttattaatttacctcttttcccaccactttttgtctatccaaattctatctttgaattttcttccttttcattttgtttctcaaaccaaataaagaagatcgagtttggataaatcataaagttatatacctataaatagaagaacattaaatgatcaaaggacataaaattaattaattaaattttgacataatttaaaataaatttataaatctcaatttttttctataaatcatttaacttttttataaatacttataaacttaataaaaattaatatttttgtatatataaaattcttaacattgtaaatttataattaaaaaatctataagtgaaaagctaaaaaagagttgggcctagctaggcattataattaagataacgatttaactaataattcattcgataagagttgcttttgttatatataggtgcttttaaataagtttacattgatagattaaggtaacaaaaatgacttttggtatcgactcatataatttatttactttattttaatatcttttatatacaatttatcagaataattacacggtttttaaaatgaaataagctcaaataaattttctagaaggcttttacagacatcgatccccaagtatgtgtttggctttacatttgaaaaattccaaactatgattattggcaaatttgttttttgtacgaaacgtttgtttaaataatgatctggagattacaatgaaacactaaacatattataatttgataaattattaggtgacgtaagcagagttagatttcagttctgtatgctcctcacatgcctctaatatctcaattgtttcttatatataaattgtaagaggctgacacagaagattttctgatcagtcatcaaataattgaactctaaatatattgctcgttatcatatatgtaaaattttatcttgcctatgcttgttaattttgtactctcgaacatgaatttggaaacttaattagttcataagataataatgcatatcaacccgaatcattcacacatcaaagcaatgttcacttcaatgggaatataaattctttaaaatcatccactagtaatacacctaaatgctactagtaatatagttgtgacaccatgcatgtttgatttttagcccaatttcaatttgttggcgtagctttgaaaattcctaaaacagaacagtaagatgatccatggtgcatggtactgagataagtaaaataaatctttttgagaattgatttatcttttcaaaggtttagaattttattatggggcgattaatttctaattagcacctttgactgtctcttttgcgtagacaaatctgctattacgtaataggtatatccattttattcaatcgttattatatcaataatatatattattatgtagacatcaatggatcggaatattttaagaggcattcaatggtcaatttatgtttttaatttgtttcttttttttatactaaattaggtttcctccctagctaagcatctctttgaaaaattcaaaaatagatatatattgaattaaattgattaaaagctgagtatttcagttattattatgtatgatttatcacttttctatctacccaaaaggtttattagtttatggtttctgcaataaaacatattttaatttgttacctttcagtctaacatattctataatgggtttcgccatcacacgtgaacttgcttcttacttcagaattttgctatgtctgtgaaggatccgctttctcaaaattaaaaatcatgagtgtttcattttatcttaaaaatatgatataataatttatatttacgattgttatttctcaaaataaccatttttttttacaggagccgctttctatgtacttgtctctagaaataatatgatttacccgatgtaatttttcccacccaatgtttttcatttttaataaagagttatttccaacagatcatgagtgtggataccggctatatcatattttaggatttacactaaccaaaatactacgtaaccagcaccacccaaaatcatcgaaagctattaaattccttcccctaccccatgcaaagccatcccacattatataaacagtgtacactaaaaaaatggttattttgaaaaataaaaatcgtaaatataaattattagattatatttttaagattaaaaaaacactcatgatttttatttttttaagcagtcatgtgattatcaaactaatttgtaatcttgattatttattatgactgtataatcttttttatcattaaaaaatataagaacaattattgatgaacaaaaagctgtattagggacatcaactaacaataaaggttttaactcaccaggagtataataaactataatacataagtcatccgatgaagaggaaccccgagatgctaattaccagtcagtaaattgatttgcttttctgaaaagaattatatatatatatatatatatatatatatatataaagttggtaaaaaaagagtttaatgattatgagtgtgaaataattttatattaccgttcaatcataaattaataaattattgtttaaattattttaaaataattattttaaaattcaataaatttatcttatataatgagttatgatgaataattatctaaaaaaaaatacactctcaatgcataacttaagaaaaattgtaaaaaattaaaattcgttgacaaattaaataatgatacttggtttagaaataaacaataaaataatagagaaggatggagaggcaaagttgtagtttgaaataaagaaaaaggtattaattgataaaaacaaagtccaacaaaatgaataaataatcatttctctctgaatacgtaggcgctgacaaatttatctttgaaagataaaaatttaatttttagtattcaaaagtgaaaaaaatgtaataaattcatttatctgctaacttctgtctattatcattaatgtaataacttacctgacacgtttaggggcgaatttatcagcgctttacatatttaggagtgaaaatgactatttatccaaaatataattattatcttcattcccttttttaaccgttgcaagcataatattacaataaatacttaaataaataagaaaacaaacataaattagaataaacataatattggtgaacaagaataatctttctgttgctctgaaatttctattgtgacaatattatgtagtgataaaagcaaattggatctcactcttttgtaaggattaacttaatgactaaatatttttgtttgcatctcatattttggataatatactatcacattaaaaatttcaaagtaataaatagatcatgcttactaatcaatattatatttattattatgtttattttaatttatgcttgatttttttatttttttaaagtgtttactataatgttatacttacaacgattaaaaaaagggaaaaaaataaagattaaattatattttagataaatagtcattttcgtccaggaatatataaaacgttgacaactttgttcctgaccgtgtcacgtaacctctttcattaacgcgataactgaacgaatgaataaatttgttgtacttttaactttaaggggttaaaatttaacttttcatctttaaaaaaggaaattaacaaaaatgactatttaacctaacaaaatacaatagggttgcattgcaagttgaattgcaagttgaggatccacttgcatgccctacctgcctaagctcctttacaagagatcaataacgacaaccaccttgtaatgtatcctctcatttctctctatctttctctctctcctcatttacctagctcgaatctcatctccaaaggcaacaaacaagagcaaaaagaagagaagaaaaaagaaaaccccttcatttcagcaacaaaactaatgcaacttgtactacaaaaatatttatactaacccactccttaccttgccgtctccaacaccctctcatatatatgtttttgcttattattcaacatcatcaacaaatcacacacacacacaaacacaaagtgatatatatctccggagagaagaagaaacaaagagattcatttttagttactattatttttattataaattaaataataataataacaatgccttcttctcttcagttggataggttcaatcctatcaccgacgccgtcaccaccgccaccgtcgccatcgccaacggcgttaactgcccgaagcagcctcaagcgccgccgtccactgcggcgcgtcgcctaatggtgccctctctctcttctggcaggggaatcgcggcctccgacacggtggcgctccaccacgcgaacgtggttgggctcaaccagtgctgctccgtggtgacgcagcacatcaacgcccccgtcgcagccgtgtgggcggtggtgcggcggttcgacaacccacaggggtacaagaacttcgtgaagagctgccacgtcatcaccggccacggcattcgcgtgggcgccgtccgcgaggtgcgggtggtgtcggggctccccgccgagatgagcacggagcggctggagatcctcgatgacgagcgccatgtcatcagtttcagcgtcgtcggcggcgaccaccgcctcaggaactaccggtcggtgacgacgctccacgccaacgggaacgggacacttgtcatcgagtcatacgtcgttgacgcaccacagggtaacactaaggaggaaacatgcgtgttcgtcgacacgatcgtacgttgtaacttgcagtcgctggctcagattgctgagaacagaaccaaaaactgtgaaaacactgcacaacactgttaactgttaagtgtttaacgatatcattatttcttctctatttctttttctttcttcttctttttttaaagttaaaatgggttgtgtcttccggtttttttgtttcaaattcgggtgtcatggacttagattcaagcccgtgtttggaattgatatgcatggatgtgtatagatcaatagggtttttcggacggcaatggttgaatctatgtgatatgtatatatgatatatgttaatgttaatgttcatataaatgatccaatgatgtagttctattttcttttttcattttacctagcaagctcttgatcgtggattgatggtgttctatttacccagaacttcgcatccgaggtggactttgattcttcttgttttgacttttgtgtatgttttccttcattcgcaacacaccgtaaataaaattatggattaaccaatgagtagttgttaatgttaacatttttaattggctagtttgtattcgtgtttagtgcgtatttttctcgagatatggaaaattgatgagctggctggttagttaaatatatatttttacttattttaatacaaatgctaattaacttgttgacccaacatattatttaagaaaaataaaataaaaaatatttttattagaaaggaaaaaattatgtttttgttgattttttatacccttttaaaatttatataataaatatttttctcatttaattttttaacatgtgctaagaacatttatgagtaatatttttatttgtcatattttgaagagggagcgaaagcctacattacacacacttgagcagctgagcactccacagcaatggtaaatgttgcaatccgaataaaggagttatgaacaataatgagcttaaatataatacaagataaatattgtatgaactcgtatgaacagttgcaccaaaaaaaaaaactcgtatgaacaatacatgaaaaaaaactatagctaaaggaagtattgtgaacactcgagcatctatttgttgaaataaaaagagtgataagaataaaataactttctttttgtaaaaaaaaaaataactttcttcgatcaatgtaatatcgtcacctaaatcaccccccggcccagtgatcaccaaaatacaaaagactatatatactagtaaacgtacaacgtacaaacgatataatatgaaggatatattagtaattaaaataatatttttaatacactactatttaagtatttattaccggataagttttacgtaagttttattagatattcagggttaatgtactctatatatatttgggatatatgtactaccagttcattaatcaccttttttttttttacaaaaccaattaatcacctaataatattaataaagagaacattgaaaatattatattgttaaaatttatcatatgataaagcaaattaattttaaaggggagtaccctatccaacgtttaagatcgtccttccaacatttaaatttgattaaaataaatgataaagtttataaaatattacttaattaactcttcatatcattccatcaacatctgaggagtctaagcattcctacttaaataaagaacgctagtgttatgaagggttaattaaccaaccagtgcgttaattaaaaaaggagaattttttaatgaatttaaacgttattaccacgttgtttggtgtccattttggttttaaaaattgagaataagattttaattaaaattataactattacttctatataatttttttaaaatcaacaatcttattataaaaaaaagtgctagtacattctaattaaattcaaataagaatgtatcttttttctatttcatatattgaaaagtgacttaaaagaacattaatacattattattaccaagacaagaagtcaaggaagcaacttaacacacacttgtacatatacatagtacacaacaattctattagcaaattcatacttttaatattctccatctggcgtgattgatcatcatcttctagtgcaatttttttaatgttctaaaccaaaccaatcgatcgccatccgtcacgatgcgtataatacgcgtcggataagccgctgcaaagttataatagtaactgccaaagaaagtattccattcattgttgatcagtctttgaaataatttatgagggatcaatgtttaacacgatgtttagaacaaaccattcacgtgttttcaaaagctagctgcctgctgatatgctttcaatgcttgtggtctaaagcgatcaaattggacgcccacagtctgcctcaaagtttcaaattcgctattttgaaatgcaactaccagccattttgaatttagctaaatataatcctttttatatataataaaactcgcatgtaaattaaagttatctctcatcacatttattattatttctctgtcttttgctataaacacacactgaacttgttcctaaattatattgagtaattaactaccaaagttatatatatatatatataatattagtcatctttcaaaagtaaattatatatattgattaaccatttgatattttctgagcgtggaaatcggtgaaacggtgggcagtggcttttacaagttgctcttttttgttataaaaatttgcaagttgctctgaagcttctgcggattgtactgcatatgtacgtattagctaaaggataactgaaaccctgatactaaaaaaacagagcacttatttgtaaaaacaaatgagatttctctttgatagccatgcacgtaatatggagcgtataatattaacaaatagatcatcataattatatttagggattgcgacgtcataataaactaatttatagaatcagcctttgaactgcaacttgccatggaggaaactcaacttgttcggcagacaatgccaagttgttattctttgccgaagctaataatattctctctttttgcgttcattattgataattgttatttatatatttcattatacaaatgtgagttgcaggttggaagggatggacggaattgcaacttggcttgcaagtgggcatcaaaagcatggccttattattttttattttttaactgaaatcctatttttttttaaggatttcagtttaattttttatttcattatgactttaaaattatatatgttttatttttttttaacttatgataattttaaagctgtaatattttttattgtttttatgactttgaaatcatattttattttatgtttaaaattttttgttttatgattttttatttacttgtattttttatacttttattttcaattcttttaaaaaattataaataattttatttatttaattattaaataaatattttaattttactagttattagtttcatttaatatattttgtatatttaaaatttatataattttctaataatgttattgaagttgatttgttttgtaaataaaataaaaaattaacataatgatatttaatattgtttttcttttaaatacttaaattttaaaaaactaaaattttaaaaaaagttaaaatattttgtagctaatattaaacttataatttatgaaataatattatttattttgtatgaagaaatttactattaacaacatgtaataatttaataataaaaataattattaaattaaaaatgacaaaatacattgatataaaatgaaaaatataaaaattatcttagttgtctatttatttgtacggacgcttattacgattatgttaaatatacaaaatattaaaatatataaaattatctcaattttaaatatacaaaatattttaaataaaacattattaaaaaataatataaaatatttaaaataaaaaatatataacatattaaataaaatcatataaaaaatacatacaaaatattaaataaaactaataagaagtaaaattaaaaatatttatttaataattaaataaataaaattatttacaactttttaaaaaatttgaaaataaaaacaaaaaagaaaatacaagtaaataaaaatcctaaaacaaaaaactttaaacatgaaaaaaaatgactttaaagtcatagaaaaaaaaaaacttacaacttcaaagtggtaagttcaaagaaaaaacttgtacgactttaaaaatgtaaataaaataaaaaaataagctaaagttgtaaaaaaaataaaaaataataaatcgtaatatctgtcccgacttttaattcagaagtcgtaataattgtcacgatttattctattttcagtaataatttaaaatcgacccccaaataaaaaaaatcaaattttttttacatccttttcataaaagtccctcaaaggcattctttaatgtttgattaaccttgcgttgtttgcttatatatacatattattagtgttagaagaattagtgtcccatgagtcatttactcattttaccacacaagacttggttaaataattgtcgataattttccatctttcttagtgaaaaatgtttgataaacactcatatattattttgcatctaaagagagaaagaaaaaaaaaatataaatatagaaaaaagatttttttaacaaccaatattagttgacaagttgagatagaaagaaaaaatatacagatataataagtgatataatttgataggaaaaaaataaagcaaaaataggattctcaactaggtgtttgagatttatgaatttaaaaaatcaaaatttataaatataaatagagtttataaagtgataaaaaataataaaataaaaaatattattaatgtatttaaaataaaaaataattcatttatcattcctctctcccatctattaactgtgtacgcactatttcgtactatttcacttaccgatgaaaagattttccccattcgacttttactcttcaatatctctctttttgactatgataatcggtgagagagagatgaaatattttgttagattaaacgcccattcttaggtttaaagttaaagtttttattcatgatgtagttttttaaaaaatttgttgattttatttcaacaatacttgagcttatcacgactacatggttacacacaattaacaatttccataccaacatcttccactgattgttcatgcctttagaaatcttagtgcaattcacctaactttgccaaggtaaaattttggcttacaactaacgtattgagtgaagatagtgtaacatcccaaacaaatcatgtcaaaatgagagagatttactgtgtaggtatatacgagactttaccgttgatgataatttaaagaaattaattggtactatatatatcaacaaaatacatctactttttggtagtttatcatttaagaatttcacaattaagtgtgtttgacttgaaatagttatgtgataaatgacattctggaatccagaaaacatatgagtgaagacaaaatatgttggtttgtgagaatagtcaatgatcgtgggactagttaagtggtgtcaaagttgattgtcgagatttcaaaaaggataacttacggaggattatgacctatgaagggttctaatcgataaggatattgaatgaagtgtcatagtgtcagaattataaaaaaaaatgacaattaggggtgttatatataggtgtgcatcgaatttttgtatttaaatacattttcattgacttttataggttgtcgttttatttaaaatttatcaagagaagtgacataaaacttatataaaacctaattatgtgaaatttttacttacttaagagtattctttctctcaatcaatttgatattggtaaaaaaaatcctaagattaattgttttttgattttctagatcgatttcatgagtggatgccaatataaaaattcgatactttacaaattcatgattccaaaattgatataaaaaaagactctctagataatcgtggccacaacttgatagataatattccaataaaaaattacaaatacagaactaataacatatagaagaccaacttgatagacaatattccaataaaatgatttttaaggtaattattataaaaattaatgaattgttacgagacaaataataatttatgatatgttgatagtataatagttatttgtggtcggatgaaagtataataattatgtaagttcatattttttttttgtctctctaatttaatacaattcttttaacatgaaatttttgtgaaagccaaaaatcactaatttcattattcaatctattcaatgcaatactacctttgattctatatacaaataacaaatgatattttttttggttttaattataagcaacaatgactaattttcaaacttattgaaaattaaatgtcttttatatccttaatttactgttaactctatttactacacgttcattagttggattatgagtattaacattatatgagatcatcacttacaacatttaaacttaaggatacttttgaaaaaaaaattaaatttatgataatattaaataagatcaccacttttcttgatcttgattatttgtaggactagagctactattaaactctaactagactatactaacttagacgtgcatatcgctgtgctccccctttccaatcaaagttcaaacttaaatctgcacactgtcattttcgaaatggatttagtggttgttgttcatatgatctagactggggttataagatctcagagtttgaagcccatgatccgggagttagttgagatgctgaataaccaagattgaagaacctcgactatccatgtgcatagggaagcaaatagttgtgttgatttccttgccaatctgggccttgaaatggcttctttctttaccattgttgatgttatcccccctctgctagaggttgtaagtttacccgtttgatgggctcttaatttcattttcccttatcataaaaaaagatatatttggggggaattaattaagtaggagcccttgaattttggacttagtcagattgctttttaaattttgcttctagctaggcttggatggatggaacgtgtatgaactaaggttaagtgtttttttgtgatattctcaagtggaggatgacctatatattgctgtttgttaaaagttgttgtagtgatctttgattattggatgctttggttcattctttattatagtaatacaattggtttaggcaagcgtggggatcttgattgtaagtacgactgcccatgaccctttcttgaagctgttgtggacttgtggtcttccatttctggtcaagtagggaaagatgaaacaaagccatttagattagtaccccaattcttggagcagaaattatctggacgatgtaaacaattcaaccttgaggaacaaggcgttgccaatttttttttttaatcgataaatattaattgttaatctattaatttttattagtgggaaaaatttgaatccacaaccctctttttttctttcttccttcaactatcaaaccaatcttataattccatgttatagtccaggttcatattattggttgaatatgcagacagaagaactttggattggtgattcccatctgtatatgatctcatttttcatcttttaattttccgaggttgtttatattcaaagaaaaattattgaaacttttatatatatacactacgaatctgaggatgggttaaaaaattaatgaagagatacaaaagaaaggaaccttgaagaggtgggagatgttggggatcacttcaactattttgagatattagaaaggttctcaagttcaacatttatcgcctttttttttttaacttctcaaatgcactttcgcattcctcatatttgtatacttgtagggaaggtaatcgttgcgctgtcaagcgtgctaattatgatctctcagataacattctcttgacgggattcaattctactttttttatatagttgattatatgaacaatagattaggttgtcctaactagttttattgatttttgctcatgggtcttggtacagtactctcgtatatttttgttttcatcttcttaagtatatatttatggcttgctgagtaggaggtgggtgggtgttaacatagttaggatgcatcttattcatgattataactttccatttaaaaaaaaaagggaattactctcaccttgtaagcttgtcttatatgattgaattagatccaacccaccttatagaaagagaaacaaataattttaaatattctcattacacatcatatgtaaattgtggtagcaaatatctttcttctgataatgttaaaacaaatgttccatagcaattcaattcatcgatatatgtgttagcacagcaccaatgctggtggacacaattaactagcaaaatttggaatttgacaatccaattacaagaaaaaaataattaactcaattttatatatacaatcacctccttcatcaatgttaatgtactattattctacacaaatcctcttttttcattcattcttgctcgtttaccatttctaacaagctcgtaggttgtagcctcccatttacaaattttcatgccacacaaggaaccgagcgaacaaggatctcttattttgatgcactttcaaggataaaataacttgacaaacaaaagctcattccaagtatctggaagtccagggagacaccaatgcacacaatcagcatagctagctgggttagctaattgctctggagtcaatgggttccattgcttcttgtaaattgatgtgtgtgcatctttacggtagttggatagttgtgtaatgttgagaaaagttataggtactttggattttctaaacacttctccgattacttgcattatactttttttagaatcagaaccccaatatgtgggatcatcaattgttgttgtttcattgtagcagttccctcccgcttcacctccccactctatgcttctgcccacatatttacataacaatgtgagtccccacaattttatgcttccatatataacaaattcttcaataaccaatactctcttgaaaatagaataatgagaagtacatctcaatctcactctaaaggttagcaacatcagaatatagatagccactatttttagcacaaaaaattgtgttattggtatattatgcgtgtgaactatactcactttgcatgagacggtgacatgctggtaaagaagactcttgtcttgttggagtccatgttcagcctcacccatctaagcatactcttcatagccatacgataagcatcctctgttggcatatcaattatctcctttactttatcgttaaaagatccaagcctaaaagtttgagaaaactttaagtaatgttttgcaatggcaatgtcaaagaaatgagagagggcaaagtaaataattgcttgaatagtgtaaagtagagaaacatacaagatcttcatcttagagccagttatccaccaaaggtaagtgttaaatacaacaatgtcagcgcctttccaatgacgaccatgcgtattgattgaaccttttctcacaattctatcagttaccctatggatgacagcattatcggagtttgattcaagaagaaaaggtgcccaatagaactcaatggtagcattgtattcctaattaaatacaacaatgaacaaagaggggagaaaagactaacatgataatgttgctaacactgaagttatgtattctacataagcaaatagtaagaggtgtacctacctttgctgtaaagacagtgagtgaatcaaaggtttccatggatttggcattttcaggaatgatttgatggagaaggcatatcaaagagacatattgacttcggttgagggagtctccaataaatatcattctcttcccacgaagcttttccaacattaatctggcattgaatctgcattttgataaaaaaaaaaaaatgtgttatgtttagcttaaattaattatgaacccttgaagcattcaatgaattgagttctttaaggtgtaaattgtaaatcaaaactatgaagaatgattagttttattttctcacaagtagggtgctcctgttaagaaattgttatttgctcatgtttattcaggatcgtgacatattcaacaaaactgtggtatgatgactaacatgtcgatgtttcgagtggactaagttccttaagcaaagtaactaaaaaaacttaccaaacatatcttaagacattacttgcatactaaattttgatgtaaccttcttaattcatataattttaatctcattaagagaattgattcatttcttgcctgaagtaccaatattaatttgatctctatatatcttttcattggaaactcttagcatcttttcatttaacgaccttaacgggcatacaagagaagttaactttattggctgtccatttttccttctcactttaaactagaaaaagtaggtatgtctgattacactatttggttgtttagtcttgaagatccattgaaattaaataatcaattatatagccttctcccttatctggcatccactcgattgtggttaagatgttgcttgtggattagatgattcttagacgtacacttaacttcaaagaccctaccaattaaaacaatctaaccaacgcctacaactcctttagtttcaatcacaaaatcaaatagtcattccagaaagaaggaaaaaacgtggccacaactttagatttctaattttctgtttcaaacttgcaataataatcaacccgaaaccaagtccaagacattaactggcttaaagactcaacttgacataaattaaaatagaaaatgtcacaaaacatcaaatttgtattattcaaagctgtcgaaatgggactggggcatcctcaattacttcattgttatttattttttttttaaagatcctcaattacttcattatatcatgttcttgctacaaggtctcaccaatggaaaacatacataacgtccttcaaaacagagctacaataacaagtgtccgattcgattccaccatcattgcaaggcttaattggtacagaattgttggtggcaatcattcaattgtgattcaataaatggctagttatgactttatatgactgcaatattcataacgttcaaccgccacagtgtcacacgtggctgccatgaaacggattcaacaaacccactccgacccaccgacaacttggacccgtaaaaaaagccacacacgacaaacatgaaaaaacacacgacacattttttaacattcttcctttttgaggtattttcaaattatatttcaactaataaaaataaatgtattgaaaaaatgttagagaatacccttataagacataattgacaaatcttttttttattcattataaaacttcattttatctttcttatatattaattatttcttttactaaattatagaagacccattattttaatctattaatgttactttcaattatcactttctcactttactttgaaaattatagaagataaataaatctcattaatgtaaaggataaatttaaaaaatattacagttaaaaataaatttaatattaatacctaaattaattaattttttaataaaaatattttagtcaactatttcttttaattataattattgatgaagaaagtatctgggagaaccgtagaaccaaagttattaaactcgaaaatttattcagtttatagattcgactcatagattcatcttataaagtcataagagtttacttcatataaaaataatagcaaactatatataaataacatactaattaaaatttttaacaatataataaaacaaaacagtaaataataatttagaatatttaaataaccaagtctagtaataatatatcactacttaaatagttatatcttggtctaatttttttagatttacttgattaggtggtaaactcgagagttaaaaatttattagagtttatagaatttacctatctattaaaaaaaagtttaatgggtgaagtaggatatgacaagtgaactcgtaaacggttgaataaagaaattaaagaagcacttacgtgggaagattgcaaccgtgaggctgccatcgccaccgctgatactccttttcgggccgaccgtgttcttgacatgttaattgtggctgtatgtacggacactccgattcctcgtacagtggccgagtcaactcgtcgcgtacccaccttccgctgaacacgtcacactcttgttcttcttcctcccttttcgttttcgtcaacaccgtcttgttttcttcggttggtggagatctcacatcgactaataatgtaaccaaaatattaagcggagataaggaacagtactgaattcaggaacaaaaagaaagaagaaaaaggagtttgactcaccgggtgtggagaagaagagtgtttgtgctgtgtgctcgttggagtagaggtgtggacgaaatatgaagacgaagtcatggccatagaggatggcagcgaagagaatgaaagctaagagggtgaagaggtaagaagagagacgaggcttcactctgagaaaggaagggaaggaagagtttgaaggtggcttcatcattttttgcatgcatggaccccaaacttagtctttcattcttctagcaacctactacaattctgattttaaattaaaattaaaagctaaaactggtgcgttgttgaagccatcattgtttgtgtaccctaattaaccgaatgacagagaggaagaagaaaaaaattaatgatgaaaataatatttgtctttgcagttttattagtattattatttttattattaagaagtagtatatttccaaggttgaaatgtttttgagcctttgagggtcagtggtgtgggaagttgaaatgttgcttgccttcacagctaagcgagcgaggaagattgagaataataataataactttccctgttcaaataggatatacattacatcaaataaacaaaaaggtgtcaacaaatatacgtggctatttttctctgggttatgaataagggtttggacatcattaggtagagggttattaggcgttaggtaacgttgcaattggaatttgcctgcttaatttgttgttaattctcacagaaacaaaagaacatatttggaccctgcaggctgcagggtattatatatttattatcactattattatgctgctgtgtagcagtgctagctggacgcacaaaaaaaattaaaattaaatcatgggccaactaaaaatgagtaaactaacaatagtaatgactaatgagttgtaatattaatcttcctcaaaagtaaataaataaatgagttgtaatagtcttttgttctattgctaattgtacacatttgatgattgattccagttttgcacatacaatgcatacattactttttttattattattattatatgctcggtctaatttggattcggggaagtagtacatgtttgtttgagctcgcacaaaatatattttattagccagaaagcactgacattatggttgggctaatcacagtgtttcacatcacatggttttaatttaataaggacattcgtttttcatcaaaataaagaaggaatctgttgttggatacagtttttgttcaagatggcagatgaataatattatcaaagtttctgcgttcagatgaagacgtgagtatatatatttagaaaaaaaaaattattgcaagccaagagaaactagaattttcttgctgaaatatcaggagagatgaggttttatcctggtttcttctatttttgagcgagaccgaccaattacgttatagcatatactttcaaaggatatcagagaacgtttgtaatcacgtatatgcgtagtacaactttaagaatactcaatagtttttcaaatcaagatttctaaaatgcttacggatcaagaaaaaagtcttattctataccattaaatataaaatatgtatggtgaatcatgcttttttcttattcttaatgtcaacatatattgttgaatacgaaaaatcgtacatatctcatttttcacataccaaaattacttaaaatgaaattataccttatttaccataagtgactactagcaggatactctttaacacattattgaacaaatttttattgaaaactacaaaagcatgaccgaaacttgtaaatatgtgaaaccccgaatttttttttattaatgtgtttagaagagagtgttaaaaatgtattattagaatttcttgacaagaggcaaatagtgggataggatttggctcaagagattgaagctggccattgaagttgacatttactctgggatatactcgggcttcattggcagaaagctaacagcataaagatacaccctatccatataaaattaactagaaatgcaagaatgattacaaaatgagaaacacgaatgaattaatggtcaaagtaacaaaagacaagttacattttcattcaattatctaattataaaccaaagaatgtctaccaaaacaattggattagctccattatagttcctcttttctttaagaatcatgctagactttcttttttgttttatcttttttttttcttcctcctcctctttctccttttctttcagagagacaaaagattgttaaatgctaaattcatggagggacaatcagaacaagaattacagatttctatggaatttttccgcatttgtctgcagaatgttggccttgtttgggagattatacgtaatgtattcaccagataaatccagaattgaaaatataatctcagaagttcacaggagaataagagctccggtaaccttcagacggtcccttaaacttcctcaccaaagatgtacacagactctgcagagacaaaataaattacaatgcttacacgaagaatgcaactcccaaccttcttgaacatatcattgagctaaagttttaaaaattcattttatcttttcctactgctaaattggaaaaactgaaattgaagcattcatgtagaagaatacctgtgttctcctaggcaagctaacccagaagtcaaggttagggataatctgaaatatagagtcaacgaaagaatattcaatcccaattgcagtaaagttccacaaaaggtggcttttatgctctaaaaaagctccgtgaatgattgacaaggaattaacattttaaaacatcataaaccatataagaaacaaaattacttacagaatgactgggtgtgtaattaacaaacaatttcccaccattagaaaagaatggagagtaatgaatttgagtttcagcatgagatgtgaaaatttagccatgtcatttaagttacccatacataaatggcaacgaataaaagtccactatgaactgctgaaagaaggtcattgtgcaatgttgattcaaattacctcaaagataataattaaatcaatggaaaaaagaccacgaataactaactgaaaaaggttttcgtcttctttttctcttttcactttctaatcattcagagcagagcaagtataaggaaacaattacggagtagacaattcacaaaacctacatgaaaaacatatttgttttaaaatttattaaaactgtgtgcatttggtccttaacgagaggctatagacacattgcttttgttaaatttagagactaaaaacaaataaaatttaaataagaactaaaaaaaatcatgtttagaaatcaaaaacatatttaagactaaataaaatgaaaatagacatacataccctaccaagaaacagagtacaagacaagtaaataacaaaaggataggagagaacatacatctataccacgaatcccgaggaagaaaaatcggtaaactataccagccaagagatatgcagcaaaaaggcacaaaacactggaatgagataagatgaaacaactcagtaatttatccaaatcacagccccttgtgataattaaagtcccaggcacgacagtaaaacccttacatgatcagtaaggtgccaaaccacccccaccctcctccatgaacatttataatgatggcacagccagatgggtgctttagctcagtaacctgcttgagaaaattacaacagtaaataatagttgtctttggttttaaattcatatcaccttcatattgctctttgttttcaactttttccaagtcattgttcgtattcttggaggagagagagagagaatgataggatgccagcaagataaactaacatgttaatagtaaataaaagaaagccaagataagaggatataccacactaatggaatatggacaacaatatcatttgataatattatgaagtttctacaagataaatgaaaaggaaaagccaacaaattcaatcacattccttgctgttttaagatttcacatctcaacatttcccagatttccaacaattgtcagtgattttcaatttcaaagttaacaaattaaaaaaatacatactgctcaaggacataaaagaactatgatcggattctggagacctacatcatagtatcatattataacaaacaatagcaaggaagcactaactattaaagatatcccaaaataaagtactcacataatcacaggcccctaatctctccagagcttgcggtccctgtaagcagaagattgataatgaaactttccaatcagtatttggttaataatttctggtttaatcaactaattttcttttgaaaaaagaacaaaaaaagaataaaacccctacttgcactccatttaaattgcaaagaacagacacagctagcgaacagttgtacttagggccactgtttgacattttaacaatgacaccagtgtgggggtttttcttatctgccattggaatagcattagaatcatatattatctagttaagttcatatttagaagcattatcaaaatcatttaaatcaagtggtgcataatagacaaattacaaaatgggaggaacataaatgaagcaccaaaaactagcaaaagaaaaccatggattaaagaaaataagaaaacagaaacagatgggaaaattgggcttaccaataatatcaacatctattttagggccacgtcctatggctgtgcatacatgataacctgcatttatcactttgttagaggatgacaattccatcctacttaaaatttcaccctaagatatactcaataattgaccttaattggacacagttcatgtatcaaaagctttaaatggttgagcaaggtagagacataactccaaaattaattttcttgaccaacagatgatgaagggggcatgttatttaaaccctaaaataatctctactacagaacgtagccactactaataattccattgtacagaagctgaaactatattttttttaataatggatggacgaattttttcagacttttcaatgagaaagcgaaagagtgcacatatgaacacagaagaaaatgaattagtaattgaaatcagaaacacactagaatataggttcttataccaaaagaagtgtacaaaaaatgagaaacaaatgaaaacaagaagaaaaaatacaaaaaagaaaaaaaaaatcttagcaataaaacttgcagaaatgaaaaggtctgataatttttttctttttctgcaagtgcaattagctactatgaacaagttcagtcatgctattactcaatattaaaagcttttaaagtaaattgaagcactttcagttcagctaacctaaggtcccatttggggttgttgtaaaatccagtttatgattttaaaacttaaattttaaaataaaatatgtttggataaaagagggtgaaatggtttttaaatcaattttaactcacttttggaaataggaagaaaaaaaattataattatagttttaagttcttagaaattgcattgtctctttcaatactttcctccacccagggacgaatctagaggggcgagcaagagcttgagccccccctccctccttggaactttccatgtatatacatatatatttttaagtaaattagtataaaattaattttgtatgttgttattaaaataatggttaatgttaattagtacaaaattgtgtaaaattagttgtgtttgttgttttattgcaatgattaaagtgataactagtgtaaaattgtataaaactagtgtgtttgttgttattattatgataacaattaaggttatcatcattcaatataaaaattagttttaattttatgtgtaaaagtagtaaattttaaaaaaaaattattatttattaaaagttagatatctaaaaaattataaaggaagaaaaaaaaattccagcccccactttatagggttcctggatctgtccctgcctccacctttctttgtccttcttcagctcctccccagtcttctccacctctcgttcagtcttcacctccactcactcagtctccaccaccaactgccacaccccaaccagtgagcttccctccccccagcctacaactctccctcgcacaactcctccatttgcagttcctccacccagactgaccctaacacccctgtcatcttcgccaaccataaccccaacgcctttgtcaactcccccctgcttcaccccatgtttctaactttccattgaatgaaatgaatcaggcaccattctggatgcagacgaaatattcttttaagttaacattttaaaggaaaattataataagattgacaacaacgttttaaaactggagaaaaaaaactaaaatgacaaactaaaaactggttttagtttttaaaattttaaaaattaaaaactaaaaaccagctcaaatggagcctaaattgtgtaatgttaatgtggtggtagaatctatatttttcggtgagagagaaagagcaacagagactagcaaaaatgacctgaattgaatttttacttaatgatcatctcaaaaaaatgcttctgtagaagcaattctgtaattggagaaattcataccaaggtcaaacacgcacttatcatataattcaattcataatgagaaactgcctatgttgcaaggtacaaaaactaaacaaagcagcagttcagttttctcacaactaccacaagcataaagcagtagacactagatgcaatttatgtacagaaacaagtaaattggaggaaaatagaagtgtcaggaattctacctccaacgttgtttgccacaagtgcattgcacttcatcccacaatgttttggccctccacaatcctaacacaaacaataagacaatcaaataagcagaaaactttgtaaaattatgggacaataaattattaaatatattacattatttcaagatattcaatgaaacaatttacttaaagcaaattgcagcaggacctttgaacagccttaaaatcctacccaatgcctatccttgcagctatttatctcttttcatctcatccttttgaagtagcatcacttttatgctaacagtgaccattaggcactaggctagactgactgattgttacttgttttaaactaaatatagtttccaattagcttcatcttttggaacatttatcatacattattagattgtgatgccaaatcattcttgactgtaaggtaacgaatctactaacatattcttccttattaaaaaatatacaacttcacagttatctgttgtggagcttctttgtttaagtgtatatacaagtgagaggaagtatgcatgcattgaagattcatactttaagtttctgtttatttatacaggctcagatctctgaaatgatttttaccatacaattttctaagaaattttaaaaaggatggataaatacaaaggaaaatgacttgaagaaaaaaatcttgtactgaaaaaataacaggaaacattatattattacaagacaagcaacaaatatatgtacaaatgctgtgattccatcaactattcctttataaaactaatttttttatccaaaacataattaattatagagtatgatcataattcataaataacgtgtaattatgattactatatgtcactcaatcgacagagaaaaaatagcttcacagaaaagagacaaatttacccagcagtcagcacatattggaggatcgtgattgaaaatcattccatcgcaaagctgctcaaacaaccgatgcacaaaattcaattatagatcaacatagcacaaactttaagctacattaagactattgtttcctataaacatatatgctgtgttttgaaagtccatctgttcatagaaagttcaactaaagtgtttgaccttgcatagttacatatataacaaacactaattcagtcattggaggacaaaaatgaagcgagtttcttttactagtaaacccctacctttatcctcaaaattatatgggttgagcattttagtccctaagatttcaaaaacccttttgtcagtccctgattttgcaaaaattcattcgttgtatccttttcggccataattttcactgtcgttttacaccaaaaagactaaagtaaatgacattttgtaaagtcttggaatattgaagggttataaaaatttcagggactaaaatggtagaatgactaatttggaaattaacttgtttctttagagttagaatgctaaagcccccctccccctcccaaaaaaaaaaaatacagattatattctgtatttatgaattatgtcaatgaccatagacagccaaatggatggaaactctactagccagaaaccaaagaaataagtgtgacctgatggagccaacctgaaaccaaagtgtggtatcatttactgccactttgtaaaatctacaagcaccaaaataaatatgaaaaagaaatcttcagtcagaactgtataactgccatatccttacatactattcatatttaaagctagtaaattgtgatataagaaccaatgctaccaccaagggtcaagggggtctatctcggttggttgagcatgtgcgtgagttattgtaaacccctaacactttcttcaatttttacggataaaaaaatgataccaccaataggtggggtctaggtagtagtttaaatgaggtcttaagttcaaaccctattgttgtcattgtaaaacaatgataaaccagagaatccatataacagttaaaatcctaacttgaaaaactaaatcctccaaacaactaaattccaaaactctagcactaccttataacattgattaactaatccgggaaatgattctaaacatgaatcaaggaagactgaaatatgaaaattcaattaataaaacaaattacagaaatatatatatatatatatatatatatcctaacaatcaaaaggttatggaaaacagagaaacaagaagaaaagacggaacagcgtcaaataaacggggagagagagagggttaagggcagatcaggaagagacccatcttcgctgaggatgccgtgagggaagttgcgaatgggagaagagagggtgtaattgtagagcgtgtttccgtcgagaaaagagaattggcaaagtgcagtagcggtggcgaaggttaggtgttgaagaagaagaagcgtgaagaaagtgacgatgatgatgcgttgagccaccattgtcgtcattgtttgaagggtgaaaacgcacgcctattatttcatgctgagagtgaagaagatgggagaagagaatagggaacaaatggggaaacatcttgtgggggatcattttagttttgttcaaaaaagtattcatattttacaaattcaatactaaattcgcgatttataattattattgcattgaatttttattgttattcaagttaggcagcaatactcaagttaattgctaacttggcactaagaatgtccactaatacagtttaggtgaaaatgacaacattttttttaatttagtcttttatttttttttaaaattattttattcacttatcttattttttatatgtagtttaatttatttgatttatttaagattgacgttattaattatttaagaataacttttttacaaataaaattaaggggggaaaataaaattaaataaaaaagcattttaaataattaatgacataaattttaaatatattgaaaagaatatcaaatttaaaaacaggaaataggataaaatattaaataattttttaaaaaaacattaataactaaaatgaaaaaaaaaattaataacaaaattaaattttttaaaagataaatacccaaactaaaaaaattaaataactaaatagatcatttaatttttaatttatagactttcatgtattcaaatatcaatcactaataataattccaataacatgtttaaataagagttttttaatctaaaaatatactaattaataaaattttataggtgtactaaccttaaacatttatagtttataatttacatagagcaataattattaaaattcaaattagatataaaagataaaagacagtaaattaaaaaaacagagaattaacaagatcaaatttatccataaaggtaaaatgtagataacttgagtttttttttttgcaagatgaaggtgtgtaataagagtgggtaggcggttcgaaccggacctaattttaaaagaatttcaattttaataaaaatataatacaataatataaatgtaaataaaatctcaataattagtcaattgcatcaataaaataaataatgttaacaaaagaaaatctaaacaataaatctaaaatatgaaatttaaaacatctccaacaacgattccatatttaaatagcttgaaccttatccatctccacatttaacaagtagaacaatgatgaattgtcgacaaaaataggtaaaaacaaaattctagagaggaaagagatgtactttgtgtgatcgaaagtgtcgcctactacatatgatttgagttattttattgtaaaaatatattaaaatatctttaaaaatatttatttgaccattatttttaacttaaatgataagaattgatatttttattatttatggcgtgtagatatgaaaatgataaattaaaaaataaaaaatcgagaaaatatcaaaaagaaagatttgtagcatgttatcatttatcttttttatcttaatcttttatttttcttatcttatatttatcatcttttaatttgaatctaatcttttatttttatctttaaatctttaaaaaaaaagttttaagtgaaaaaaaagaaaaaatcaaacataatataattgtgtcagagtcacacaaatatattataagtagtagattataagtataaattatattataatattagaggagatttataagtagattatatgtataaattatattataatattagaggagatttaaagaaaaagaaataaaataaaaataatatttttgactaacccgtgaaatgaaatcaccctagacaaggtacaagtacaacaaaggaaacgaagttgctacaaactgaacggcggcgcagccatggattcggagttccccaacaaagcgttaacgagcacgcgtttttccgacctgaatccaccactctctgaaccggttctccaagccctatcacactctggcttcgagttctgcacccctgtccaagctgccactattcctctgctctgcagcttcaaggacgtcgccgtcgacgccgccaccggttccggcaaaactctagcttttgtcgttcctctcgtcgagattctacgccgctcctcttctcatcccaagcctcaccaggttcttgcatactcttattatttctttgaacaatgcaagcagtctgctattcgaatttatagaatacccgcatccctgaatagttgtgtcattgatttcgagagagagaaattattattaagaaaaatgttgaatagggtactggattttagtcactggtgtgtttgttagttccaatttattttgttcagcttgactataattaggttaaatgtacatttgttgtaggtgctaggaataattatatcccctacaagggagctatcaactcaaatatatcatgttgcacaacctttcatttcaacattggctaatgttaagtccatgctccttgttggtggagcagaagtaaaagcagacctaaagaaaatagaggaggaaggagcaaacatattgattggcacgcctgggcggctatatgacataatgaatcggatggatgtcttggatcttaaaaaccttgaggtatgtgtttcattcttcattttcaggtatggtttgacattgtttatatacattggacatgaagatttactgttgaaaaaatgttcaagatttcttttggtcttgttgacaaaataatatttggttgatgttgttgcatcctgcttcaagatccctggtcttctattctatgtatgctttaaaagagggacacaggttaatgacttgacgctgtaaagttatgtgatctagctgaagttgttggaaaaatattccgaatagagtatttgatttgactttttttttatttttttttattttagccagttgacattattatgactgttcttacagattttgattttggatgaggctgatagactcttagatatgggattccagaagcagataacttctattataactctcttgcctaagcttcggagaactggtctgttctctgctactcaaactgaggctattgaagagcttgctaaggcaggattgaggaacccagtgagggttgaagttcgagcagaaacaaaatcagaaaatggtcctgcatcatcaaaacaaccagaatcttccaaaacaccttcaggacttcacattgaggtaaaacttatgaggcacactagcatgctgctggattggatgtaacttaacagtggttctttctcttacattcttactagaatccatatagcaagtttcatgtactgctaatagatgcataatacagtttatgtttatcctttgcttatactgatctccttatccttttgagtttgcagtacttggaatgcgaggcagataagaagccatcacagctagtacatatcctgataaagaatctctcgaaaaaaattattatgtgagatacacgttgataattaatgatgtgatttgtgcagtagaagagtattttatcatacccaaaacatcattttgactctaatgcagatatttcatgacttgtgcttgtgttgattattggggagctgtccttccttgtctttctgttttgaaaggcttctccttgattcccctgcatggaaagatgaagcaggtatagttttggcctttttggatgttagcatttttctatatcgaagcataatattctataaatcagcattgtttttcttatttcccattattttgtcagtgtcttaccgtttacatatttgattatttatttattttgccttatagtctgccagggagaaagcactagcttcatttacatccctttcaaatggaattcttctatgtacggatgttgcagcacgtggactggacataccaggtgtagattgtatagtgcaggtattgtctattgactattgcatttcaattttcatcttctttggttctgtctctctcttggttgctaaaccatgcattgtggttgaaatgttttcttgtgcagtatgatcctcctcaagatccaaatgttttcatacatagagtaggtcgaactgctcggctgggtaaacaaggtcatgctgttgtcttcttattaccaaaggtttggtcacaagtatattcatgttgtaatgcttttgatatttcatgcaggattctttagaagtgttgattttattgtaatgtaatctatacaaatgtgtaggaggaatcttatgtagaattcctgcgtataagaagagttcctcttcaagagagaatatgtgctgatgaagcatctgatgttgttcctcaggtttgctctaggccttttataatcttattttttttgttttgtcataatatttgtattgacacaatagaaagatcctttgcgtgctggttaatggttagtgatactcattagatatatgaactaattaatccttttttctaacttctaattgagtaaactaaataatcagtggaaataaattccttgatacaacatgacgatgccctgattgccaccaaggctgatgctgattttgttcattcactcttttagaaacttttttgtctttttgattgcttgtttgagtaaacatgcttaccagtcctatatttatcaaactgcaaattgtatatgaaaatctaacatatttcgattttccaataacaacactattgatcaaacttgcttcagattcgttctgctgcaaaaaaagatcgcgatgtcatggaaaagggaattaaggcctttgtctcttacatccgtgcttataaagagcatcactgttcctatatttttaggtgagtaatgtttatgaataatgttgttttcattttatagtgaaacgtcatcattatcaaactaattattctcactcttgcaggtggaaagaacttgaaattggtaaattggccacaggatttggcttattacaacttccttcaatgccagaggtaaaacaccactcactttccattgatggatttgaaccagttgaagatatcaatttgggggacattaagtacaggtaaaaacattttcatagcataacttttctagttcttgggtaaaagcattgccaagaaccatttctccccaaagcttaagctgttaggtgaaagcttatgaatgatataaataattgaatataatgtctaacatgccataggagccttttgggccttaagcaaaggctgggccaccttaccttgtgctaaaattgatctttttttttttattttgaataatggagatagaatgtgtcaaactctctgtcctgaacacttggtcaagagtctctaataccatgtcaggaaccttcactaccaaaaagtcaagctgttaggttaaaactcatgaatggttttacatctaataagaatcaattgtaccaatgttatcggagggaatgaaaaccatatataacttacttctgtcttactttattgtaatacttttatggggtggcaattgaatgagtgccttaatgtggtttgtttgatttgaagctcactaatgttgaggactcatgttggaacaatataaaaatagttttggcttgagctagattaattatgtatgatatttattttattttttaaaattataattaaacttaactgtataactatagtttaaaataattaaattataattcaaattgagactgagcttgagtttgaaaattaaaatgcagtcagagcttgagctttgattttcttcaagcttctcccgaatttttatctgaattatgagcggaaactgaaaactaatattttaagctactcttgaagaggagaggtatttggaaaccattcttttgtttacttattgctacgttgatctggattaaaggattatccaattcccctttttcgatcatagaatgatggaaattaatttcatgtcttgtaagatttacaattgactataatatgaatgtcctggattcatattgtctttctatggtcctaaatatacttttcctttctctcttggaaacccatgctgatggcttaacttcaataatatagggataaatcacgggagaaacaaaggaagaagaaccttcaagcaaagaaagaagccaaagagaaagagccaaaacctcaaaaaccgaagaaaaccccaaatgcacccactgacatgcggaagaaaacagcccgacagagacgtgctcagcagacaatggaagacgaggaagagttgatgcatgaataccgcttgttgaagaaattgaagaaagggaccatagatgagaatgaatatgccaagttgacaggcactgaggaattactttgaaagcaaagtatgcatgcctgattatgctgttctggataccatggttgaaagcaaagtaatgaatgacagtttcaaacaccacaattttggctagtaagttactagattcttgccatgtgggtacactgtaggcatctaatctaataatataaaatttgttaatccattctttggcatggcatacatggacgatgactagggtttaatttttttcccactttaggaaacaaaaatatgatctaatacggtacattagatataattaacggttaaaataactggagactacacagaaataaattaataaaaaaaaataatacatcaataaaaaaaattaaaatgcattgtcctctttcctttcgtcttctctgttgttttgccggcaccgtcggcacctctcacggtcaagtgtgaccttcccttgcagcttggtttttctcatcggaaaaccttcccccatcgcccaaaatccctaagctcgaacctatagacaaatggctttaacacccacacaccccaagaacaagaagaagaacaacaacctttcaataaaagctcgaacctttcgcgttggcgtgtcaaagaccaccacctatcgtcatcctcgtactcgtgcctcagatctgaaaatgcacttcacgcttcagatctaaaaatgcattcgcaccttagatccagaaattcgcacctcatgttcagaatccatggccttgcacacacggatttgttgtgacaatctggcaaagagagtccaagctagccttcttgttgtgcatcctttcgcgaatgatggtgatgctgatgacgccaaggacattgatggcgcgcatgggctcgccaacactgcaacccatgttgaggattctgtggctgggcctggcctcaacactgacgaggatgcttgtaatggagatgttggagttggtgaggccaaggggatagcgacgaaagagagaaagaaaaaaaaaaaatttaaaaaattaatctggtgtaagcactcttccaatactctttcatttatcttaaccgttaattttaaagagtgcatatcctacgctcaatatttattttccgatcacttacacaccgtgggaaagatgtatcgactacacattggttcagatgacacatgtcatcatatcattataatggttataattatattaatgagtatagatttgaatttaaaaatttggacataattttcggatcacatacagctaagaaaagttagtctcaatcagtattaaaaataattataatcacaatcacaataaaggatgttggttgtgaaaaaatatctgacagaatagttgtatgagatcatatttgacccgaaaatttaaatattgctaggtccaataatataaaatatataattaaaactcgtgtgatctactataaaagacgttggttatgaattttcttttttgacaaaataattgtatttgatcatatttcatccgaaaatttaaaaaggaatgtgagaatagctaagaaaaattagtctcaaacaacattaaaattaaaaaaaaaaaaacttagataaaattaattatttaaatttaataacaaaaacttaccaattacaaatcaattattttagtaataaaagatgtaattaaaatattttaattacattccatgcagtattagttataattaaaaggtatattgtgacaatgatgcaattagagattttgggaggactaatgggttgcaggggtcagaaatctcaaacaacatcatcttgttcaaaccaaatgatggggagaacatgccggtgtgtttctttgtgagtgctaaggtgactgggacttggacagaatggctaatgagtttcctttgaatattgttcatctgaaatctccttgtagctctgcaaggcatgattatgtagagtgggatatggctgctgatgggaatttctcagaatcttgaagacaatgaactttctaaaagtgtgtgcatggcgttaggatgagccagagcgcataaagtttcatctctggaagatctccctacaaatgctttgagagttcatcgccatatggcggtggatgataagtgccctctgtgtaatcaatcttccaacagtgctttttggtgcatattgttggagaagctgatgctctctttcatggaggatgatgatgttgcaaatttgcttattaattaattttgtctagggtgtctttgcctagacaattcagcggaaaacaaatgatgcaactagagatatcatagaaaaaaatattataacttttacgtacggtcattataaattacttatttaaatattaattacatcaaataagatacataatatattatcttcatggtcatcatatattatatattatatattatttatttaagtattatcttaaataaagtatcttcataatatattaatgctttttaatataaatgcagttacttttttttttgttgagttataaatgcagtcactttaatactcacaagaaatgatataactattggtagtaggtaccctaacctggaggaggcatgcaaatcaatctataaatcaagttgttgatataccttatgtttgtgtcctctttggtaatataataaccactgttttttgcttgcaaagtaatattttagcttgaaaatgcagattgatatatatatttatagaattgagtcttagctaaatttaagagtgacaaaagttcaacaactaccattgatgttgttgcagaggtgttgatatttggtataggtttttgttttaaaaccatctagtttgatggaaaaagaaccttaactaatatgaaattcaactttgaaataaataaagtctgattaataattatttttttattaagaatcaaatttgaatattactcaaacttgaattatttttataaaatccgattctaccttaattttaacatatttgatatatgtgtctcttttttatttaatcataggcgagttgaccagtttctcttaatataatttgtgatttagttatgagcgaggtgatatatacatgagttttctttaatataatttgtggtttaggtgtaactaaggtgatatgtgtgtgtctatgttttttttttccatttcttctacttaatcaacccgatcatcctataatgatatataaaaggttaaaataaaattttggttttttatttacatttttttgtttaaattcagtctcttaagtttaatgttttttttactttgatctcctaaagagtacttgttagactaaattgatcattttgttaagttatcacattaacttgatcaatttactagatgtgacaaattattcttatgaaagttaagttaatatagtcagttaaattatgaaagatatcatgtgagataaagttgacgtagaaagattaatttaatctaatagagacattatatgagatcaaagtaattctttttatataatttaaggaagaagattcatacagaaaatatataatataaataagacacaaaaattatattttaacatatataacgttatgttttttaattctgattttttttctttacttccaaataaataattgacattgtcaagaagcagtattggtgccaaggaaattcggaaaaataagtaaaatttgatgtactatgtatacttagaggttgtttgaccgtggaagttaaaataaatgtacgttgtaatgtcatattagtttttgtaaaaagaaaatatttatttattattattctttttggtttttaaatttaattttctaaaataatattaatccccagacgtaatttgtcccctgcgataacatgcactagtcctttgaaaaatctatagataaatacatctttcactagtaatggagtttgaatcgaattccatttggttgctgctacaaccattaaagccttcaacaatgaactgaattacatttacagattgttatacatatggaaagtggtgcagtgcaaagagttgtgaatcaaggttatgagtagcgtgaagaaaattaatattgtccaaaatagtttgccccaattagtctttacatacattgatcatgtgattttgattagcctgacagttttgccagatcatcaaagtagaaatatgttttaggtgtttgtaagattaataaataaagtcatattaaagaatcttggcgtgtactcattgctgaatgttggtgtattattaagtccatcatcgcctagttggagggggacaacattttttttcagcctttgaggtagttttgtccatgaaagcgttgaattaaaattagattaggatgttttctttaatgggaatgatccttttctacctttggaagattactgagcattaaggaaggctaagcctgcaaaagctgagagaggcaaggttgaaagcaactgaatgaaaaagtgaccaacttcattcaaatttcaaagtaacaacaacataaatatctctccacactctactttaaaatacattgtcatttgaagattggaagatctttaataaaattataaacctctgaattgaattatacttaatcttatccactaacgtgcgtaaagtgaatgatatcgatcttaattttgctttacacttcaccatttgattatcagatttcggaattcaaaggaagcatttttcatcttgttgtactcaatttctccataccaggttatctgcagtcacatttcagtagcaaaaaggcattgatgattgttggctcctccttctcaacagaatttggtggggtatagagtacggatacgaagttcttttttcgcagtcacactgcgtgacaactggtgtcactcggtcacctcatcaaagtaagtataattttgttgtataaattcgtgaaaaaacttcattgaactatattctttaaaaaaaatatttttaatatctgtaaattgatttatttcagattcataaatggtttattttaaaggtcaatcttaattaacttattcaatcaaatcaatcttataactctcgaattcataaatcgtaattaaccgaaatctttaaaataggatactaatcaataaatacaacaatgatacaattatcatgatcgaaatattgtaaaaattgactttataattatcatgagcaaagtatttaattgtttaatcaataaaaagcttgattacgtggttggttcaaatggtattgtattcgaatttttttaagtaatgtaagaatttgagtattgtgaatgaaaaaaataattgaaaaataaattttttattaaaggtgatcaatcaaatttttccaataaaaattaattataccaataacatggtaaaaaaaaataaaaaacttaattcaacttttttttttttttacaatagcagcatcaaatctaagttcttatgcatttacttcaacttttcattacaccaaccctaataggttaagctttattcagcttaattattgagaaaaatattttttttaaataaattaatttaaaaatatatatatttgagaatatattattttaaagaaacatttttatataaaaaatttgataaaaatattttacatagaaacattttaactgtgtacagttttattatatcaaccaatccgattttttgacgacttttaaaataattattataaaaaagtttatcatatgaaaatttattattaaaataaaagtatttgtgcatatattatttaaacttaaatatgtttttagtttctaaaaaaatgttttactttttgatccatataaaattatttttttattggtccttattattttgttttagttatcctataatatatttattttttattttagttcttataatatttttttattttaaaatttttgaaaaataattaatagagactaaaaataaataatttatgtgttatgaaaacaaaaatgaaaagtatatatattataataattaaaacaaaataacaaagatgaaaataaaaaaaatacaaaggaccaaaaatcaagtaaaatttaaccaaaagcaaaatattatatttcagtaaaaaaaaaaaaagaaaaaagcttattgattcattgtactgtatgttgaaataattaatactactagaataattagttttcctttgtccggttaaacagataaacgtgaagtgaatgcttaagctcaagaagcatcatgttccttgaaaaagtgaagttagcgtaacaattgttggtgtggaatgattccttggcttctgggagcagcctatataaatcgccaattcttaataaacgtccgacacatcctacgtttctttgttggagcaattcagatactgtacccattcgtgatcatgtccaaccccaaatcagagtcagtagtgtctgaaccctctgcttcggaaccttcaatacccatttcatatccaataaaaactcttgaggacttggagtctcgctcctatttcgagtcctttcactaccctttcaacaaagcttcttcttcggtcaacaattcttcttcttcttcgttgcccaacaggcgcagattgcttgtgtgccatgacatggctgggggctacttggatgataagtggattcaaggtggcactaaccctgatgcttatgccatctggcattggcatttgatcgatgtctttgtctacttttcacactccctcgttactcttcctcctccttcgtggaccaacgctgctcatcgccatggtgttaaggtactttcttcaacacaattttggctttgcttgatgaaaaatgtttactttttaactttaaagtttgtgcttgttgaagacttgaagggctggaaatgagttgagctaaagaaagccttactggacttgattagagttgatttggctccaagttttttatctgattttttttttcatctcgaactcgattcaattcaagtttgctaatggttcggtttagaatttatttatgtagttcaagttcagatcatttatcaagcgtgtttatttggttcatgaactaagttcaacgagttagctatcaattcgagtctggaactaatttcaagttggtttgattcattgtcagcccttggctctgtgaaagttagattgataatataaccacacggtccacactcatagattttagaattttgacaatttgtttcctctttttgcttactagctatcagctttaaagctcatttaatcacttatacagttggtttagtttaaatgttcaactgatccaagatcatttagtagcttcaaacttcttttctgattcttttattggagctccagctttatggcatttgagtttgtttcttgcttgtagaagtttctgacagctcatgctttaattaaaacaaatggattattctttagttgtacttgttcctttaatatttcaggtgttggggactttcatcactgaatgggatgagggaaaggctgtctgtgatacactgctttcgacaaaggaaactgcacatatgtatgcagaacgtctggcagagcttgctgctgatctaggctttgatgggtggctagtaaataattcgttatctctgtgtgcttattagctttatattcttgtctattactccatttgaattttatattatataattgaattgatatttgatttccattcacttccttttatgagtaataggtgaactgttggcctgcactaccagagcataagatgcttctaatgtgcatatagtgccaaatttaatagactaaaattatttgaatttgggctcttatgttgaaggtgcatcgtgtttcatctaaatagtgcccagattgatatataaataaatatataagtaaataatggggaataataatattgtagagattttacaagaacaattacttggatattttttttaacttaagttagtaaaatctacagttttgacaagagaagtttatcattggaaatattataagtagcctcacaaccattgtatatttagaaatttgccaaatattccttgtgaattgtcattatgaagtaaacatattagatgcttcatgcatatttataccaaaattcaaaacaaatatgtaactgtttttctcatactttacagccttgcatttttggtattcatgtcaactattcaaactagtaacattttattgcagataaatatggaagtaaatttggatctcggtcaaatttctaatttgaaagagtttgtagagcacttatcgttgagaatgcattcttctgtgcctggatcattagtgatatggtgagtattagatgataagtcagcaatttttgtattgctgtggattgtgccaaaagttgactttgatgtgttttcctggtcatgtaggtatgacagtgttacacttgatggtaaattgaattggcaagatcaactaaatgaacataataagcccttctttgatatatgtgatggaatatttgtgaactatacatggaaggtattgcttatcttcccctggcatgcttgtgcgacacaaatgtttaatcaatagtcattttccttagttaattttaatgactaccatgtaggaagactatccaaggctctctgctgctgttgccagtgatcggaagtttgatgtgtacatgggcattgatgtatttggaaggaacacatatggtggtggacagtggaatgtatgtgttctgtgatatacagtctgctatcccaattttgaacttgtttggaaataaattttaattgttatgagtggaacataggtcagaaattgaatttggtctattggacatgtatattcttagtgaaaatgattattttacattcaacgaatatcatagatgatctgcatgttttatttcactttaagcatactccctgtgtgtgcatggtctttctccagtgtttcatttctgctttagactgcatccctaaatacgcaaaaggaaaaaaacaagtcacacaaacaacaacaaactattcatttcaagaaaattaattacttctcattttggcggcaaggctatgaaatacctcgtgttcttcacatttaatttcattaataggattaacagttatgattaaaattattaaatatggttttgcacagtattctagacattttaatcatcagaacattggtttcattctggttattgcagaatatatatgcactttaatgttaaatctgccttcagagaaatttcttactacatgtagaaccccttcccttggtgaagcatccaacttgcctgtaactagatatacttttactaaaaagataattatcacttggtcttgttttcttactgcattatatttgaaatctattcatgaaaacacttgctgtcagaggtttttgtgggacatagtcttgtgaaacttgagctgccaaacaattttggacaagtgttgtatgtgactggtaaagttaataggatatgtgttatttcgcttttcttggtaattatctcaatgttgtttatgtgctttctttattctcatggatgtctcaggtaaatgttgctcttgatgtaataagaaagaatgatgtctctgctgcaatatttgctcctggctgggtctatgagacaaagcaaccaccaaattttgagactgctcagaataggtaacttagctacctgttttgcaatactcaaaaaattattgcaaattttctttcacgaggttaactgagttgatgcatcttaatgtattgaggaaaaaaaatctactgccaaagtagccaacattgtatatacagaaagaacattaagttggggatgtcacaaaggctagaggtgaaataaaaaaaaaatgatgaattcaatccatctctagaattctaaatatctataagaagggatcttgttgaagaggatgaatataaactatagttgcctcagaaattgcacttcaatatctttaaagtttttgatttaattttatgacatctttaagcttcagaattttcaatactaattcagacaaataaaacctgtccttttcgtctcttctattctttttgggattacataacataattacataatataatacatctggatgatccccctaatttgcttctctaaaatgtatcacatgactagcttggtattttatttcaaacattctctagactgcatttcttcctggtcactaccagaaagaaaatattaattttgtgaagaagttttgcataattttagaattcatgatctttaatgcaatctgcctttgtcatttgaaataaccataaactatagtttagtaactttagtttcaagtttgttagtactttgattccccaagagaaccttattttataaataaggttctcaattatgcattttagcattaagttggttcattctatagtttctaattattcaatcccgagtaaggaacttcactgatttgtgccaatctcttagagcactttctcttttctaggagtctgatcattttttccctttgaactcttcaaagtcatatattacaatacttatgaaagcagaaatatttaagattttgtttgtcctattaatcatattgccatagaaatactaaaatctttcatgcattttcaagtgtattacgatggtgggtgcaaacatcatggtcagactttcttatatttaatgacggagatcaaaccttaaatttcttactcatggatacagcattattgccatgcattaatattgcagttggtggggtcttgtggaaaagtcatggggaatactgcaaaaacttcctggagtactaccattctacactaattttgatcaggttagcaattgcaattattgtcccctttgatatttgttcttccattgtctaccctagtatttttttgtttttttcattgtacatttggcatctgcttttttggtacattctgaatttatgcacattttattcaataagatttatttttaaattaatttcagtgaaagtgattccaagaataatttgtgaatttcaagaggcggatggtgaatggactgatattttttatatcataagacaaactaaagaatttagattagtgtacatcaaactggcaaggaagaggtgaacaacacaaaatctagctctgaacccccatcgaagaaataattttctgcaggataacttaaaagcctaaacaagaccctagcaatcttcttcaaaaataaataaataaccttaacaatttcccttctgtgcaatctcactttagatcaaatacttgtgtaacctatatttcaaatctcgcaattgtatctttcaaatatatcatatatcttttgtttctttcagggacgtggttatcatatttcagtcgatggcgataatgtatcagatgccacttggtgcaacatttcttgccaaggctttcaggtaagtgtaatgcacctggtaatcatttttcttattgttggctcaactatttaccatatagattgtttgatagatgacctagaaaagattatatgccctttttttggaattcttagttttccatttctaagattaagggctatttaacattgtgaatttatgatactggtttaaaatctttattgtaatctaactcaaatatttgtgtgcagccactccttgagtcttctgatccaacaaattctattcaagtttctgtagagtaagtgatggtgcatatctaatattttaaaatgttcctgtaactggaaagtgtaacagaatgtgcacatcacatattgtgtctgttcaaaaaatattgtataacagcatatggctaaattgaacaattcatgtctgaaatgtgaatgtttgtgtgaagaaaatttagcggtcttttttcttattgagttaagaagatttatctttgttagaattatgatttattattaatcttcaataattttcccatcccctggaacttctttatcattactgggtgaaaacctagagttactttgtatgtttagttagttttctataacaccaaaaccttacataatattaaatgtctcctttcttttctattcttccattttaatgagatattgaattactacatttcagatctagttctgacatgatctgaagtatttattgacttgctttcaaattgcagcttgaaggaggcatcatatagtggaggaggaaacattacattcaaaggatcccttgaagagcaaacttactatgagagcaaaatctttcaaggagagtttcttctgaccaatttgcctatccactttatttattctgtaagctatatcttccttatcattattgctgaaaaaactgcacatcaatatgttatccttggttttaagaaagccatcatattcttgtaacctagaataactgccaatgcagcagttcaattagattcttagtgcaaatcagtctgtcccccttgggaactgaacttgatgtaattgaggtaaggtaaggggaattaggatgtgttatcttgatcaatggaataatatacatttagtcaaattcattgaaaagattgtgtatgtactatccctatctgaaccctctttttcatgactaatgcaggtgaaatctgatggcaattcttcattgggacttaagcttgagttcacttccggcgaccaaagagcatctgtgcttctcacatcccgggcagtgaatcgtttctcaagcaaattcagcaaagtaatcatgacacgtgagcacaagggattatcctctggatgggttataaatgaaggtgtagttgcaatgaatggatacactttaacagaaattcatgcagcgtgctatagatcaaatggcaacgatgaaactgtggcttccccatcagattattttgcacttcttggccatatcacaatcaagacttctgactataagtcagattttcctgtgtcttcttcctggctagttgatggcagctacataaaatggacatcagaccctctgggttcaaagacccttgatcttaaaatttcttggaaactaaaaaatggacagaattttctatttctgaagtacaacgtgtacttggtgaaattatcaaaacaagcagatggtaatccaggtacaacattagaggatgtgaaggagtaccttggagtagcacaagtaaactgtttttatgtttctgacctcgaagttccttctgacacttctagtctcaaatttataatacaagcctgcggtgtagatgggacatttcaagaattggatgagtctccatattatcaattggaggttgaagatccctaaattgtcattaaaatgtaacactactctaatgaaggaaggtccctaaattgtcattagagtgtaacattattcctccaataaaggaagatccataaattgtcattagaatgttacattggaattggacaattcacgtttatgtttgcagtaagttatacaactctttaagagattataccaaataaaccctcgctttaaatttcatgctcaatatacaactaacatgaccgaaatagtagcttaacttacatgaatgaaactatttcgagttacttttggacatcatatggtgatgtagagccaagtttttttttttacaatataaattaaattatcttctcattatatattttatcttctcaatataaattaaattatcttctcattaaatttacttcccaacaactctatttgatataaggtttgattttttttaaaagaaaaaagtttgtttttaaattaaaaaactggtttataatattttagattaactagacaagtttttaattgtattaaaaaattattgtttttaaaaaagttaatattggtttctgaaaaatcaatttaatataacacacacacacatttaagaaatacttttaaaaaaaaaattgaacataggctctatgaaacatgtatcaacactaaggctattttctcgctaataatttgagtttttattttgttcgaggtgtaaaaatgaactttatattttatcaatatgttcaatgttagggtatgaaccctaaagctggcttcgagggcagcaaacctccagcaagaagaagaagacacagaggtaagaaaagggaaatatcattttctcattcatccccttgcttgttatttacatggatatatatagcattcctcttaacaaatctgtgctattctgctcaaggaatattacatcataacagaatttgttatgcacgaatcaagcaagattttcctaattactgtattgcccatactgccctctgcttcaaacaaaatcacgaaggtatgatggccctgctatccttctcttggacctttctttttacacctctggtttgctgattgttaccattgccttctctgttccagcttccttgttgcctatttctggtatcctatcatttcccgccctcatcaaaaacaccttgtcctcaaggtgttgggcgttcaaactacagcttccaaaagcaataccggggtcccaaggttcattccgacgaacctgcaattccacaaagtatccgtgaggaaggaacatcacgcgaaaaagagttggagcagtccaacaaggtaagctcagagagatcgatagtggaggctggaagaaggtgtggggacttctcccaacaacaaggaggaccactcgaatgccggagagaaggccggcaaggcgcaaaattcccggtgtgaaatctcccgataaggatttcagaccaatttgggccgggtccggtttgggtgtggggtgtgcggccgggtcgtgtgtgggttttggccttgggtcaggggtgggttttggatctgggtcaggtatgggttttgggtcaagtcctgtggatccgggtgtgggtagttgcgggtcagggtgctttatattaggacccaatgggtctgtgggttcctcattcactacgatgaagggaagaaccctagagacctcgcgacggccgccatggagcttctcctcgcctgtgaggcacagcccgtgctcatggcgcgaggctaactcctccggggtgaggcagctaatggtcggggcctgtgggggtcgcggcggggatggcagcaaagggggcaaggttgcgatgtgaggaggaaccaaaggggcggatggtggagctaccagaggtggggttcgcggccgcgaagacgtttgctgctccaggagcttcgcgaggccggcggcctggtccacagtcgtaggctgatgggcctgaactgtacggcggatctccggttgcaaacctgagatgaagcaaggcaacaggaaggtgcccggcaagccgataattctactggctaaggcttcaaactccagtaggtatgtgagcactgaccccgtctgagtgagtttgaacagggcaccgacagggtcctcaaatggagatggtgcgaaccagggtgttgcaggagcaaaagtggcttgatgaggaaccggtggggatttggatgtgggggggaaaggcacaggagcatggcgggtgaaaaatgggttcaggtggcggttcatggagtgcatggcgtcgtccagacgagcaagggcctcgtcgaggttgcgggaggccatgaggaacaatgatgaaagcaccaattgttagggtatgaaccctaaagctggcttcgagggcagcaaacctccagcaagaagaagaagacacagaggtaagaaaagggaaatatcattttctcattcatccccttgcttgttatttacatggatatatatagcattcctcttaacaaatctgtgctattctgctcaaggaatattacatcataacagaatttgttttgcacgaatcaagcaagattttcctaattactgtattgcccatactgccctctgcttcaaacaaaatcacgaaggtatgatggccctgctatccttctcttggacctttctttttacacctctggtttgctgattgttaccattgccttctctgttccagcttccttgttgcctatttctggtatcctatcattcaaagtacttgattatcaaaatattgaataaattatcagtgatcattctatgaaatgagtatgcatatgcgtagcaaataattgaacactgcaacattatctttgtaagtaacgttaaaatgtttcagttttttagacaaaacagctttgttcgggttcacattgtgatatggaaaatttagtatcaataattgcattcaaattcatggaactaccattttttcctagcctcccccttcaggatacatcacacacacaccgtgaaagttaaaaagttaaaaggttagaatttttgacatagcagttatgtttcatgcacacatggtgatgtggaaaattttaagatggatatttacattgcctcaaattcaacacggtgcaaccttaattttcttctcatatcatgtttatttgtttagcattgaagcatctgaattccgaaacaaccttcagttttggaagtattatcctattcctcgagccctcaaaaggaaaaccgggttcccacaatcactttctttgtctacacaaaaatatagaatttcagattgataaacaacagagagagggacgtgccttttgtcttgttatgtattttaatttattattaatattctactaattctcatctgttctctgtcccacgtactgaagtttcaagaacaacaagaggagacacactggcacttgtgtattggcaaaatggcaatactttggctgtgatttatggtgttaattgctgttatagctttgtctttttacctgaaaattgagtaaaatatcatgcagatttctggcggaagcctagtgaaatccttgcaagaaaaaccacaattgaagaaccagacattttctttgcaactctcattcttccttatacctgcagctgttactagtgcgaaatatcacaaatataatgaagttttagagtgaacaaatatttgtccttaaagtgcgtggatgaagtaatatgaagttatttcacttcaacatgtgatctccagttatagtattataaatataattacattaaatattttgagaaaatcaagtgggtttaactcaaatgattaaataaaatgcataaattattataaatttttgtatatattttttttatttttatagataaaaaatactgagagataacttcattgtgaaaattgtttttattgaatatcaaattaaattagttaaatattaagtttattggactcattacaaatggatcataaattagttgattttaaaacattctcagatgaatcatgagttatttttcgcaaaacacaaaatcatattaattacaaccatataaattattgaaatgttgcaagaatacaaccttgactcttgctgctaatgttgaaaaggataaaataaaagaaaatagttatgattttttttatcagtaaatagttatgatctatgaacttcaaaatgagatagcatttactgttacctttttttaaaaaaaatgtatcttaatatgtgtgtatacgaaaataattaaaaagaaattcaaataattaaagataatgtttactgatatagcatgtgaagtcttttttaatgttcaactaacagggctgtagcataaatttccaaaccattacttcaatcttttctatccgaaacaacttctgacacaaacattgcaaacagttacagaaagggtcccctacttcctccataacataaagttcttctctttattgataaaataaaacagctataaaagggaagcttaatattactcttgtaattaagcaaggcaaatgatattacccatccagtttttgtaccagttcatttttaagaaaaaaattatttttatttattgataaatttaaaatttgaaaataacatcatattttgtacaatttatcataaatgaaaaaagaaatattaatgaaggtcatattaatgaggaagttaaaagtaattctaatatatataaagtattaattatctttcttaatttatctgttatcttttaaagtggacaaataaaaaatgagtgtcttagtttcacaaattaaaagatttattattgaaaaactaaggctccatttgtttacccgtgtaaataataacatgatttgattaattaccaatatgaatataatcgttgtaatatggttgttgtataattcacgagatgcattcaatggcagtggaattttcttctcttgacaaaacctttgtatccaacactagccaatcaagatctaaatgtctctttcaataatgcgctcatgattcgggccatattttaatttagaaaatgaaaatattttttaatataatcttgttttttcataaattgttatgtttatcttttgagaaaaatattaaagcaactttttaagtttttgtttttaattagaaaagcatttaattattattatttttaacatattgttaattgaaaaaatatttttgccattggtctgattttctacactactcaacacaacaatttgctcaaattacaagtacaactacatggcaacaaaatctgatatagttaaaaaaaaaaaaaaaaaagagtaagtacgtcctttcatctacgatcattatttgaattcattagtttcagtagggagaaatggtctttgaggtattttctataatccactaatcatcaagtaattgcttttctttaaaaggaagtatgtgcttaattacaaatacattaattttgatgaaataacttttaaaaaaaaatccctcgcaagtttttaataataaaatttacctcaaaataagttattaacttaaagcttgtccaaggtaattaacttgcgtcatggaccatggttgttgtacaaactcttcaaattaactttgattatgataaaaaaaaaacaaaaaaaaattaaaggtcaataggtcaattagaatcacacgaaacttcagagtttggagggacccgacctaatccgaaagaaggtgcactgattagattagaatggcagtagaataggacactagtatacggctagataaagacaagaaccgggctaagacaaggtggattcggtagagataaattaaatgaatgaaaattcaagtttgactagaaaatgtttcacattaaacaaagctgatgaggaatctttcaagtttaactcagttgttacaccattttttttttctctctgaattaatttattaattaaagaacagtcggttgtcgcccactattaggcttttcttttctcttgagcatttaagataataatgtgctttgatttggacataaagttgtttagagagatggatatagaaaccctatacatataatatgctgtgcacatcccataaaccgggcactttcttgcacagaccccccacgtgaaccagctagctagaagaagctgatccaaatgagtaaacctcttgaattattttaacgtttttctactatgatgattagaagattgggttatatatgccaagaaatggacagctgagatatggaagtatttgataacttttggacaagaaaggatatagtaatggctgaaagtaacatgcgtagtgtaaagaagagacacaaattaaaggaaacttaatttgtgaagaatatgtaaaaaaatgtaaaaatatcctaagaaggaaggagaagttaaaggaccaaatagaagatctcttattttctattttttttatttagtttttaatactagtaactttcttaagatttaattatagacttaaattttctatttgtccctgattttggttcaatattatttattttattgcaccaaaaatcttaggctaaataaggatccaaattatggtcaatttataaatattctcttcttgttacttagtaattatgaagcatagacatttcttttatttgaagtgtcccaatggtaatgacaatttttttaaattaaacttatctgaacacttttttatacatgttagagagtttttattggatttttaatatatatatatatatatatatatatatatatatatatatatatatatataatacgaatgtatctgttttattcttgttaataatcattagcttgttatggaatattaaaaaaaaaaactttgttatgaggtgatataaaaatattaaaatctatgaactacaaatacttaaagtatttaataaaaaaaattagatgctttataagaattgtaaaatatcttataaaatgcatcatcaattcttttttaaatggtatttaattatattaccggagggaatatttcatttcattaaatatgttataaaaaaaatatacaaataattttttatatgcttgtatggagtcttgatcgatcaacaaatcattattctccacatttttgcataccaaatataacataagtctctgctgacagagtgacagttgtatcattatcaagaccttagcataacgctaaaactactttttacttcaaattaaaaaaaaaaaaatatatcggtagctatagcgtattgcaacaaagggggtgatcatgaaatgaaatgatgcatgtagcaattgtttggtccttgccttttttggatgacctcggatagaagagaaaacgatcgatatatggttatgacctgtgaatgtgatactactgacgatggggattgtaaaaactaaatgttggaaaccgtgtcgaacaatgtcatgaatctcatgcaagtcccccaagttataacaaggttacgcggtctaagctatgcaaaactttcatttcttattagtcactttttctcttgtaatgaacatcaaaactacaacactgaaaacaatagtttcctacacgtagccatgcctagtcacatgttggtgcctggtgccactattaactcattaatagagatgaaaatataatagattaatcatgagatttatgacctaagttatgttaattcagattaggaatgacaacaagattattgggttgtccatccccacttccacggtgaagcattaattttttggtggcttctacaatagtttccacatatcattgcgctctacccagtagtttggaagtgtcttctcactctattacttttatgtaaaaaaataaaaataggctaatagatttacacttttatacaatattttttttctatttgaacatttatatacaatattctaaaataatatgtatatagtaggaaactttgagttaccaatgttaatttaaagtaaattaaatttataaaatattttaattcaaattaacattgatttaatccataaaaatataatagcttttactattatcctaaaagagtagttaaaaataaatataaaaatattaaaaaataatatttattattattaatatatttctaatataatttttaatatttttattttttaattatttttcattattcttgtaacagtcgaaaatataaaatgttctcaaacggagaatggcacggcttttcagggtgttgaaggaaatctaagtagaggtccacaaaaagagtttcaacacttattcctacttagaaacaacaaaaatacaattctagtggaaaaacaaaatgattttatgtttgccagacttgtgagttgtctttcaattactacatgagatggtaaatttataattaatcatcagaatgtttgccattttaaaaaagaccaccgaccctcatctgaatgcattaatgatcaagcatctcaattattagtttaatgggttaattactacagtattagtactaattaggaacactctgactgacttcatcggtacttaatcgcaggctagagttgactccaaaacagcattcctctgtcttaacttcaaaaaaatagtatagaagttcacagaactttcaaatgcttcacatatgtatatggaatataagaggcggctaatcactctttaacatatattttttattattagttagtatttattaaataaaaaggaagctttacaaaaaaaaaactaaagattctgtctaaatgatttgtaaaaagggacaaagaactcaaaagcatttgcattcaagaaaccatgtcatgtccaaaaatgctctctcttgagaaagaatcataaattacgttgctagaagaggcatagttgaggtactgagggagttcattttggagaaggtaagatttctgatctgggtcttccatttctgggtttggcatcagtggctcctgttgcatctggatgcagagtatctctgcttgagccactgcaagctgcatttgaagctcagaaacctggttttgcagatgggatatggctccaacacaaccatacaccgggtcccgaactcttgcatgtgcttcatacaccaaactactcacagcatcccctctctggtgagccggaagttcctgaagcaattaatacatctttacatcttagaatttgggtttgagtctaattcaatttcaaaaactagttcaagaaatgagagttgtgtcctactaatactattttgatcattttactagttgacgtgggatttccattttccagtaacataacagaagatatggaaaaccattttgaaccaaaaaagttatcaaatccaagaagctaaaaataaatctaaatataccttttttttttcatttctccttccatagtaaaaaaaacaagctaaggaggcattggtagtgtatgagatacctgaagcattttgctaacattgctagcaccaaaaaccttgtgaactaaggcgaacttttgaggatcattggaagggaaatagggagcaaagatgcagtccttggtacacctgcgtctcagcagcttgcatgaagcacatggagaattcccagccattttgattatagaaaggggaaaagaaaaaaaagggaactacaaaaattctttgtttgggagttaaagcttaaaagtataaagcaggaaaacggaaagttaggaacacaaggcaactgaacttgacaaaatgagacacaaggagtgtgtatttataatggccaacaccgtgtgaagctagcggctagcctttttgtgcaatagtgtgatgtgagtatcactttcaagtatcaatcagactcaacttctaaagattttttattttcttatcaaataaattaatggattggcttatttaatttcctatgacaaggtcatgtgtaattttaaatgaaagatttcattactcattctttctgaattttattatgtattgcacttatatttttttatgtctgcatttgaaatagtatgtgctttgtggttattttttcacaaaggaccaagttgtacaagtggtcaattgaggacacgtattcaatggtgattggagattactcattatgtttcttacgagaaattctgcatcacactcactatcgaaagttgcttactgcaagagggtccaaaaaggccatggtgtccagatcgttcgtgaacaaacctgatgacataggcttaaaaactgtggtcttaccatatttttcttaacatcatactataaaattattaggtgcctttagactagaaataaatttaatcaccaaaaaaactagaaaaaaaaattcttgttttctcattccccgtcctttttattgatttaaatattgttgtcttttacatatgtcatacatgtctattttttgaagtaaaattcaaggtgctcctgttatagtatatattggcttggatttgcacacaacatattttttataaaagtttttatattaaggaaattgagtttagttggttaaataagatatgtgagttattataaaaaaaatttatatttaatggacaaaaaaagtttttattgaatagattaagtctctctcttaaactcttttcttatttataggtagcatgacatgtttctttaattatcccaaccctcaattaactctaactactttactaactaactatggggttacctatcaatattttgtttaattttaaaatattatacaattgcattataaaatatttgaagaaatgatttcgtcattcataatgttgtgtttggtggagaggaaaggaagagagaaatagtatagatttcatgtaggttttacacttcttatattttactttaatttaaatatctctcttttattctcattctctctgccaaaaggggagttttatatcctacttaaagtctcgaacataactacttcttatggatcttatggagaatgtctttgatctcaaaaaaaaaaaaaaacagtatgtagtggatacaaatacaagtatatatagatatttattatcggatataaatacaaacattattctttttacctacataggtatgaatctattaaaaatgagttattttttaaaatgtgaatataaatataaatatttcaatatattattcaaactctacccctaattgaaccatcattatccttataatcaaactctattgccggcgtaaatggtgctcggatcgagactgccttaaggcagatgaggtaatcgcctgaggcctttagggcatgttcagtaacctttgggacgtgatcaggagaagcagaacaagcttgcttaattatttttagaggaggataccgtccaatggaggataaaaaaatgatgttgataatcttttccttttttacatttgaaggtattaaaaaaaagtgtcttcatgacattattaagaaattaaaaaaattattaaaaatcatataatgcatttaaaaatcattggagaagacatttttatgcatttcaatgaaaatatttttctttttattttttttaaccgctgttcttaaaacattagttaatatttaccttaaaaaatgctaacaaaagatattaatgccttgttaattagaagtattaaaataaaagattgattctttttaaaatgtatatattgtttataatattttattgataatacttgtaattagtgtcacaattaaaagtagctttttataaaaattgaaaatgaaaacttccatttgaagtcagcaatgttataagataaaattgaatacattatcaaagagaaaaacattataactaattaattatacattttttatatataattttaaaattttaaaagttaaaagaataaaaaaatatagatatgaatcctatttaattagaatttaatcatataaaactatctcaaaccctaaaaattttagacactgtctaattagtgttaaagttagaactccaagaactagaagagaaaacaaaattatcttatggcacactataataagcggattcgggtccccatgggaagataaaccaaagttatcgtcggcgcctccaatggttgtaaattgaaatactgactagtgagggttggctaatgtgatttccacgttgtttgactcttaaacgagtgttatagcctgtttagttgtgcttagttttagagtataggactagggtttgtaagaaccgggtcaatacgaagaaatgaagctcaacgtggatgtttgttagacatacaattacaaacactcacgtgaatacacacgttaacattactttctctttctgtagttgtgcgcatactttgactcaattcaacaattatatatatataaatcaaagcgaaataaatgtctagtgtgcacataacagcatagtataaggacactctaaaaatggggatatatatttattgtactccttaattttatgcatttgaaccgtttaatatattatcatatgagaataaataaatatatttctttattttaataaattcaaacatatttattatcacattttatattttacatactgtatttttatgtgtttgaatatcttcctcatttgtatgtattaaaattattttttaaaatagtttgctccctctaaattcaggtcttagatcccacacccattactattaaagtattttgaaattaatgagattgaccgtttctcaaatttgatgtgattttaaactcaagctggttggtaattattctaaaaatggggatctcttgtttttttttataaaaaaactttatatctttaatctttaaatctttaggtaactgtacgttaatatatttgcttaagggtcgagttttcaagaaacatttagaaaattggctgaatatcgggtgataagtcaatttaggaccatgagtctaaaatacatgtataactcagtctaaaacttgatatatacacaagtctcaactcaaagaggcgaatgaggattaaaagattttaaaaataagcataatattggcatatatcttgtctaaatccgaaagggtagaattagtatatgatagcgtggttctcttaatttgaagtgatttatcaacaaattggtttgcttcttatttacccagaaactggagttcattcaattcatctaggctagctagtcctcgcccatagtttagcatgtttagtgaacggttttggttttcttcgttttcttgagtcaagggtaattttgaatagtataatattagatctttcatatcaaggaaaattctgcccaatatgaaacacatacatcagaacctcgtcatataatagattttatttttaacaagttggaacatagagatgactaatctcgtgagctatgattgtatcactatggacttaggcccgtgttatttttaagagacattcaaatattcgtatgtatgataattagatcatacttaaaaaataaaacataagtaattcaatgtttttattgccttttaaaaaaatcaatgttttttttattggaagttagaaaaaatagtttatatacgaattctaaaaaatcacaaaaagattacataaaatagtttagcattaatttgtaggaagtatacatatgcccctctcacggaatggtttcgtctcttactaattgataaatttttatttacgcactcagatttggatttgattactactgcattaatatataaataattaattaattgcttgcatgcatgcatgcatttgtattaactagggctggatagctagcttaggcggcctctactatcatggtgattaaacttcacaccctacgtactctgtgtcttgtttagaagagtcttgatgtgtatcgttatcgtattgtcacttctttttttaattcatcccaaatagacatgtaagtgataggacaaatagtagtcacaccattattttattctcttctaagcaaccacacgagatgagtttcatttctgaattttgaccctcccatgtattaataagttactcttggcaagttgttcgtatataaatctactttgattacttaagctagggagttgataacatatagatctactttaattacttaagctagggagtagacactagttagtttagactaaattataattttgatttttttataatttttaatatgtgattttgattattttatttcttatttaaaaaatttattattttgatttgatttttaatttttcatacatttatttctttttttaatttgattaattaaattatttttttattatatctcaagtgaatatgttaaatttggaattcaattaaaataaataaataaataaataaaacatgtaaaattaataattagattaaaattatagattttgtttgtggtactctggctcaccttataaagttgtcttataatcttagtaattttaggttttacttaatttcaaaaactaattcaaaaaataaaaattgtttctcaattatatattatataagttgattttatttttagtcgcggtaagttttctcaacagttgtatttgccttaaatataaccggaaatgataaagtgtttttggtatatttttattttttctttcttttcccagcttgcccctgtgctccaacctctccttcgaccctttcactctcaattttcctctctgaaatcttcacaccaccatggccaagaagcaaaagcttcaatcctccgaccccgaaccatccaagtcaaatcatactcacagtcaatcaaccaatatgttcggctctgttttttgcagtaaggctcctagaccacaaagatcaggttcatggtggtggcggcaccgccaaagtagcacgtcggcgagtccacgcacgagagtccactgggtgtcgacatcttcatgattttgtaaagggtgatgctgttacagtgagtagtgttagtgagagccatgtgaggatgcgctgtttctgagcgtggaatggaaagtcttccaccattgtttggaagtaaaccttgttttttttttaaattttattttggtaattaatcaaacacaaaacacaaaacacaaaacataaaaaaaaggacaatagtaatattgattatgagaagacgaagaagaaaaaacataaaccagtaatggacagcgatatacaaagcccattggagcttttgcttattggacatggtggtgtaaaggtttgagagagtggagaattgagagtgaaagggtcaaaggaaaggagggggcaaacatatggctgagatggctagcatggaccagtaaaacatatggtccattatagactagtagtttgtaaccactagatttattttaaaatattggatggttgagatgtatcacttgatacctttgacataactttttttaatattttattttaaacggagtttacataaatgtccctttatagttgacacaattactccatttcagtttgtcttttttgttgtcctattcaccgcataggagaacgatgcttgagacgacaatgagggcgatgtgtggttagcttgtcgaccttaagaccgttgtcgtctccttctgcaacggtgtgtttgattgaaaagagaagatcaaaggtcgaagaagaagacaaagggggctatgtgcaaaccatgatgttctcataaccgacaacattagctcttgctcaaatcctcggatctccttcctagatctgatagtcaccattctctagatcttcgctgccacggctccaatgttgtgaatccttaaactcaccgtcgtcgagctcctgccatggtccccaacgtccctgacctcttcgaagagaaggggcacaaatcttggaatcaaacatcaaaagaacagatatgagaattggtgtttgtattttagagcagtgaagagaaatatacagttgagatttggaatggtgctgaactcatccacaacttcggaaattttcatttttttggtgcactctaagtgcaagaagctcttcttcatcaccaacagtttctgggaattgcagattcaatatgttgaagagttccgatcattgggaatttttgtgttacaagtttgctctttgttcgttccctttcgatttgaactttgatgttctttaaattgcagtagtattttaaccaaagttggcttaccttttttgatttgtggtggggaaatgggtttcctgctacttgtgatgtttgtgtaaacattgacgtcaaaatcgcctctgacaacggtaaacgatgatcagtaggatgtcggataagatcgctgaacctagtccaaggattaactaaataaccttaatttaaatatgggaaacaaggttattgtctaattttatgaaaaaataaagactggcatataaaaatgaaaaaaaaaaaaaaactttctatgtctgatcaaaagacatggtccataatggaccatatatttcactggttcacctaagttttcccctatatttctttggctatcaaacacaaaaatttctttccccaccctagtatacatattggttattttcttaccaagttaatgcattaaaacatgtcaaaaaagctcaataaacttataaatgctgtagatttgtcaagttccaaatattaagagtaattttaaaaaaaatgttaattaattttgatgctactaataaaaaaattgcttttgcaaattaattaaaatggtctcatatataagagaaaacataggtacttttgcaaattagttaaattggtcaataattttctaaattatgcttaaaattaattttataactgctggtaaaacagagaaaaacagagaaattattttgaaattgaaatcaaatataatttataaacattctcttctattaattcattgagacattttttaagaataaaattgccagcctcacataagaaaccaatcggataatatctcaaatgttgtaaacccaactatgcaactgacttgtcatttggagaaatatattttaaaaatggataataatgtaaatacaatcaaaacttttaaaatagtactagctaataattatttaaaaatgagtgttaaatcagattggactacaaatagaacttcaactcctaggaaggtgagaacatacatggaagctgagacagaaacttgccatttggtgactctgaaattacaaatctcgatcgaagacaataaaatactatgggtgaaaggtaaaaaaacatgagacctccaacgcggacattaaatgagcatcgtggttatgaagattcatttcgagatgcatgttgttctcttccaatgatattatgaatagcaagattatcaaatttgaaagttttagacttgtaagagttttatagactcgattcgtgaattcaatttatagattcgtaagagtcagcttcatataaaaataataacaaaatatttatgaataacatatcaattaaacatttcaaaagtataataaaacaaaatagtaaatcataaatttcagaatatttaaataatcaagtctagtaatgcatcactattagataataacttgcagatgttatagtagtgatagattattttcatcgaggatttgatgttgttagataacaagagtttgatattattaaatgtaagaatttttgtatttgagaataacatattaaatgaatgtatgtttaacacggacataaaataatccaaaataacttatattttggtctaatttttttaacttgctgacttgttgactcgatagtaaattcgggagtctaccgagtttacttagaatttatagagtctacctaaagtctaataaaaaagagtttactcaagagtcaactcaaagagggtaaataaactcgtaaactcataagaattaatgaattaactcgagagtttgataaacataattttgagaatgcttgttaaaaatttagtactagtagaaactttatccttcatcgtcgtcccaaataactacattagaaaattcttaagggtgaaattgaattcctctcagtccattttgaattgcatgagatgcactgggtgtttgaaaaaaattaatcaatgaggattcacacactctctccacgtccaatagacaaaatttgttgaagctactatttgttgtttttgggaagacaaggtttatcatgtcaaatgaggctttaaagtcattttttccaaacaagcaggcaattgtgaaattcaacattttggatggcattcaagaaatttataatgctttatgctctaacaagtttttggatttttcaacctaattgtaaacctaggagagtttctcaatttatgaatatataaagatgattttcttgtactacaaaggcactatgtgtattaggacggggagagagtttttgcaatacttttaatttgaggatcctcacggagtgagggtcttaatcttttttggtgcagtgtggagtgtggttggatgttggttcgcccttaaccgagagcttatctataacacaaagtcctagaagttacgagtgcttatgcatgaagtagcttacagaccaaggacttgtccatattgtagtcttgaaaactaccagtgcttaaatatgaaatagcttgaaagtacaaccgaaggcttgtccataatatttcatttttatataaaaataaaatacattgtaagattaaaattcctaaaattgtaactacacaacttcatgattcctttggtggcatttaagatacttaatttgtttctctatttaaaagacttgattacgaggacaaaaaagattaattatattggtaaaaaaataattataaacttagttttgaaattaattcaccagttaacttgagttgaattttgaaaaagtttgattaaatctttagaaaaaaaacacattatatttaataaagggtaaaatgtgttttttgtttctctaaaaatttctaaaatctgattttagtcctttaaatttttttatcctattttcgtttttataatttaaaaataatttacttttggtcctcttaatggcatttaatgacaattataaactgtcagaaaagttaaattaattttatttaattattagtaattcagccatctaaaaaatattaaaccactcactcactccatttttaaacttggtgaaatccttgctatcatttgggcatgcaggtgccgcccaaaagctccatcaatgagcgaggtagtgccattgaccagattgtgaccaattgtagcattgggctgacgaagcccagattgtgcccaacacaaaacatggctacagaattcatgacctttcttttgttgtttgatcagaaattccttgttttatacacacaaaaaaactaaaagttaatatcttcttgtgtttgaccagaaattcctttttatgtttgaacgataaatcagaagaaaaattctataattatttaaaaccaatgcttattttcatattctgttaagtattggacagcaaaagtaagcggtcatgttctaaatgaaatcacaaatgatggaagtgtatatttgtacaattttaaacgagaaatgcttatccaataaaacaatgcacctagacaagtataacccttaaaacatgttaattaaagtttattaatagagataaatttgacttgaaaattgagaaaatctttatgcttttgaaatccatgattagtcactgtaatggtaatcaaaacaactagtaccaataaaaaaatctagaatcttaaaaaacaaataaacgtgtggtgtgacaattcattgaaatatagagaccccaaaaaaataaagaagaaaaaaaccgtagccatgaaaatgatgaaagaaacaagtagcagtataaaccaattggagttggagagaaaagaagaagaatctagaaagctgaaatgaataggattcacagcagatatagcaaagctcacactaacatcaatttatgataacaacctcaaaatcaagttatcagtgtgtcaccctgacttttcaaaaacaattatttgttgcttcatatttcactgtgatttcataatagattttcactcatcttacttgactccaagcattctatatatctagtgcctccacgcatctctaccctcaaatcttcaccacacaacactacctcaattactcaactaaagcttcattcattcatcgtgtcgtgttgtgttctttgcaaccatgcttcttagaacagcgtcctctttctctctcttcaacgccaacggcgaccatatactactcccttcctctgttcgctactctcagggcaaacacttggttccatgcgctaccaagaactccaataaccggcccttaaccggcgtcgtatttgaaccctttgaagaggtcaagaaggagctcgaccttgttcccactgtcccacaagcttcccttgctcgccagaagtacaccgatgagtctgaggctactatcaacgaacagatcaagtgcgttcccctgcttctaccttatctccttttttttttttttcttttctcacttcaaaaaataaaacttttaattattgtaagttttaactttgcaaattttactattcaaagtttttaactttttgtatattttaacgcagtgacgtgtgaaaaaaaaattaaagatataacaaaatgatgctggtaaatctaatgataaaatacacaaatagaaactgataaaatttgagaaaagtataaagttggatgataagctttgttaaaaaaataactttaatgtgataaaatttataattaaaccaaaaataaattaacacattaagtctcttttttagttatattgatgaatcgttataaattacatgatttttatgggtagccagggtaggagttgaagaagggcttttatctgtttctgggtttatgttgtttgatgggctttaatttctttttcttcttctgcttctctttgcagtgtggagtacaatgtttcgtacgtttatcatgcgatgtttgcctacttcgatagggacaatgttgcgctcaagggtcttgccaagtaatgttttgattatttatttataggttctgttgtgtagggttttttgttttttaccttgtgagtagttaattaatgactgatgattacaggtttttcaaggagtcaagcgaggaggaaagggagcatgctgagaaattgatggaatatcaggtagtataaattacagctttcaatctccgagaatatgctgcatgtgtcaattgaatatgcaaattttcaatcttgtcttctagaaagtgattctgagattttatttttatttgtgtgtgttaatgtgattttcagaacaagcgaggtggaaaggtgaagttacaatctatagtgatgcctcttactgagtttgaccatgaggaaaagggagatgcgctatatggttagtgtgtctgctatcccttcttctgtttagttttttcatgtgttttatgatttataataaaacttttcacttttgtggcattgctgcgcatttagtttattaagatatgtgtgttttagtttgtcgaggcttatatttttagaattttaaaacatatatagctaagctgaaatgaataggattcacagcatcctcaatcgtatgaactccaattgcttgttttttagtaccatattccttgtatgttccataatctcgagctcgattgtccacttgaaatattctataaaatgaaatgaattctgatttaacattgcgtttatcttttttatatgcacacgttgatttaattctgttaggaagtacattatttcttaattcttagcagaaacgttgcatacaaatacacatgatgcaatgtaagccaacttttgttcaaagtgttttgctttgtctgatgaacttcccctgcgaaatttgtatgtttggcactaaatgtattttgtgtttgtttcttgttgcagcaatggaacttgccctgtcgttggagaagctgacaaatgaaaagctgcttaacttgcacagtgtaagatatcaagattgtttggtcctagttttggattcatagcatgtttggatttgattcaattttgtcataatcaattccaaaaccacgttgaaagctaaaacaacaaatggttacttccactttttcaaattttcaccatgattttaggtcttagaatcagccatagtagctatccaaacctgcatgacatttgtctcatttatgttcactttgatgtttttaaagtggcaatccatatatttgaacatgttggatgttgtttgacaggttgcctcaaagaacaatgatgtgcaattggcagattttattgaaagcgagtttttgggtgaacaggtaatgtgacgttgcaatttattaaactttcttatgggttactggcagaatggtttgcacatgattatatgcaaagcactgcaaggaagcttttgtcgatctaaaactcagcacttttttttaattattatttgggtaggtggaagccataaaaaaaatctctgaatacgttgctcaactcagaagagttggcaaaggacatggtaagaaattctaattcagctacacgcaacttggttgaatttttctttccctagttctttcaatgaaagtattagcaaaaaaaaaaaaaaggaatctaaaccctttgttttcttttatggccccaactttcaggtgtgtggcactttgatcagatgctactccatgaggaaggagttgctgcttgattaacattttttttctacctctcgttcgtgcatctagttagttattcggattagtattttcaggtcttttaatgctagagatgaacaaagtggatatggagtaatattggtcatttgtatgtcgtgttttttttagtaatattggagtaatatggaatttgcgtattggactaatatggaattgacgtattgttggagtaatatggaattgaaactcaaattacaattatatttttgttccttaattatttgcataacttaaacatcaagattataattttaagttaatttcaatttcatgcatcaaacgattttaaaagtgaacggtaacttttaaacaagtgttatttacgaaacaatagttattagtttttctttcttttttttacttctcacgcttatttttctcttgagacaatcctctttttagacatttctttaaaagtaatgtttggttcgtgaaatgtaaaaaagaaaaggaagaaataagagaaaataatgatttttaaattctttggtaggaaatctttcttctttttattggattgtatggaaagtaaaaaaagatgggaatatgaaatattatttctcttctattttggattgaacactaactagacgaatatccccgtgtgcgatgcacgggctatttttgttaatatttgtttcacttttactcaccaaaattatgaggaatcacaacctcaacctctgataacatgaataaaacttttcataagtatatgttaattcgaccattaatagaacaaaatattaagatgcagtattaaattatattaatttaaataaattgtgtttaagccaaaaacaattcaatcaaataaatttgatttgttaaatggttgctgcttttttgaatattttaattttttaaaacccaaaggattaaataagttatattcaatatatgtttatttaaattttaccttttttatttgtatatcagtttatatttgataataaaaaacgttactacgttaaccgaaactaataataccaaaagaaatatattaaaagaaaattcattgacgcattcatgtgattagtaacgttcgaaatacgataaccattttctacagtaatttaataataaatattatttaagaggacaaatagtataacttccttaagtttttacttgtacttctataacttcattatgtgagaagatggaaaagttctacaaaaatattatcatatgttgattagagactttattaacaaagattggcccctctctttccaacatattctgagaagggaatagtgttgcagctagcttggctgagttaggttcctcttaagaccatagctggatcacttttgatgagtacccatctagctcacagtgcccatctaactcacgggtccatcttcttaaggatgctgccggaattagttcttaagactgagaaagctttgctagtttttttctcactctgctgtcttttatttttgaagcatccaaaaaacacattcatatttgtgatgagaatcatgaactgaccaaatacaggttaaaggtcctagtggagaagaacaaaaactaaagtggagaaggagaaagtccctgaatggaaaaggatgaaggcccaagtagagaaggatgaaggtccatatctatttttatcttttgttcagatacattataagtattgattttgttttcaataaaaaaaacttttgacattttcataaaattgggtgagagtttctctccgaaagtggcgtctatcctgacttattttccttcaccggaagtggcgtcatccaaatcttcgtaacctctatcaagcgatccgctcctagtcaggttcacatcaatttgttacctatgttatcttaatacgttcttaattctcttttattacataaacatatatcagcttgacaaataataattcaattgcttatttttatgtagtactttagagtgttcctagatattttcatgcttaaagaccttatatatccaactttacatctcgatccactatatttctcattttgtcttgtaaatcataaaagttcagttagaatgctggaatgttacacaaatgcataatgctgagtacaaatatgcagtgttgtggtcttcttttcacaaaaaggaagacaatagtgtttctcatgtccttgtcttttaatttgcataatatatactggttggaagaagtcacataccaattgaatcctcttataacccaagatgtaattgactttactgctttggtttaataataattttaaaataagttcaattagaagatagaagtcaaatattagaagacaataaagacgtttagtatgtgcactatatcacaggcatggacggatcaagagggcaagtaggggcctttgaccccttccttaggatcctatgagtttatctgagaaaaaaaaattaaaattaaaaaatattaacataaaaatatgcttttgagttattatctgtttaaaaattttctaataatagattaaatctctgattttatccataaaattaataataaataacttattacttattaaatcattatttatttaaatttaaatatttaaataattatgtaacaagaaattccgttcctccccttttatccactcctgagtccgtctctaatcacaaggaagcaaaaaaatgccttgtttgaaatataattctaatagccagagtaagaaaccaaattacagaaaagacccgaacactaaagaaactttttagaatataattaagctacacttgtactcaaagcattatgtagtacatgttttgatttcatgatccgtggagttgtgtgagatgtgaaggggtcccattgttctcgtaacaactggattcagaaaaggatttaaaaagctgacctaaaaggagttgatcaacaccatttttggccaaaaatctcttctcatttgtgtcaacaaaagctctccaatattcctcaaacctcaaattttatgtagacaaataacatttccaactgcacagcaggtttatatccatataacaatgcttaaaaaggagttctaaatactcacgtgaatgacctgttctactacgtaacagtatattttgttgaaacaatagtctttgtatgatagagtatataaattgtgttcttttgcacaggaattgagacttataaattgtctcaactaactcaattctcaaacaatacacctaaagttcttatatagaaaatcttcattcaaaaaatgcttatccaaacatcccttggtgatatgatggaatcgtggctccaattcatttgattcgtgaaattgtgatgcacagatggatactacaaattctgcactctttcgtaataaccaaccaaacctataaattgtagctgcttataatatagcattctcatagattggtaacaacacaggatcaattttctcacaaaaagtaaggagctcagaagtatgcaccatgtcataaataacattaacattttttacttggaaaaatgcctcaatgagatttaaagaataaatttaacatactacaaattagttgtgcaccctgacccatcaaaatactatgtacatctacaaggcaatctttagcaacgatcccatttaaggcaagtacatcaattttacctaattgaccaataagatttgtgagaggcttccaattgagaagagtcatgcaaaaggtgtaaatttggggagcatagaaaacatacagttatctaatagaagaataagaggcaaaggcttccacaatatcatgcttctgcagagtcttgcaaggaaagagcaattgcctgcctattcataaacatcatcatataatttaagttcttctattcagaacattatgctgctcagttgcatgcaacaaggtttaggatgtgtatcaaacaaaaccaacacgatgcaaacatcaaaacaacttgcctcaaatcttcatcatcttcaataatgtactttgaactactaacatgcttcttcccagagacgttggctttcattttcaaacctttattcttcacctaagtaatattaagcaaagggaaaaagattataaatgataaaataaatttcaaattagaagtgaagggtgtaagcacaataagtctataactactatgaactaccaattcacaacccaaaaaataatatgcaaaatgtagaagtgcctctgtttctcttattctaacacgcgttgtgaaacagagtctctgtttctcctatagtcctatgcagcgttggatggagatgcagtcggtgatgaaaaaacagcaagggcgtgtttgatactttcttttaactaacaataaaaagatatgataaaaacacaaactataatcaacaaagtgaacaaacacaaataatcaaaatgaaataaaccattaaaaatgtgaaagtaagtgatagaaaaattaacaataacagacaaagaaacaatatttaatagataacaaaggacagataaatagagaaaacttttattaacataaaattaaataagatttagcaaggaaaaagggatcatgtatcacaacttcagcattttcgccaactccctaatctcgcctctaaactcaccacccaagccatgaataaaataaaactctcttccaaagctgatgatgaaggacacactttgcttggtcctctcatcatgtcatacacaccttcattagaagaaacattaaatacaggtcgtaatttatttttttctaatggcccattaccgttttcaggatttccgtaactcctaatgttatagacatccatcaaaaccaaaaaacttcaaaggagaaaagaaagaaatctcacataatgaagaagatgatcacgcgaatcttccttcaaagtcatgcatctacgaagtctttatggatttccgatactatatgcaattgattgggatgcaggaatcaataagaaaacgttacaggaatctatatagacttttcaagtttatcggtttaaaagtattgagacttactgcataatttttttttcattaagcgtgctttattgaagaattcaaagagactctacatcgcatataaggttgggattaagcaccgttcctagttactcacttatgcagcataatatttatttaaaatataaataaatactctttatttgcatggatttctgaaaacttacgtgattaaagccaaattttgggcgggatatgcataaacaaatggaccctcattaagaactcaatctctccattggatagtcttagaatgaaatgtgagaagcctgactcaaccccaaaagttaattcaagggacgaggaaaatattatttttctctcccctttgttaaacatcattagcttatataaatgattacaaatttaaagataaactactagacggcttccgacgttgttgttggtatgaatgagagaaatttgagtcattaattcaatacgatgtgatttatgatatgataattgtataaaaataaaaataaaaattacaataaataattttataatcatatttattttgtttaccataactaaaattaaaaaagcaagtaaactataaggacaaaaaatatattaataaaaaataacagagaaaaataagatgaaaaatctagaatttataaataactaaaaaaatatgatatattactggtatatattgtaaatagaagatagaataaatttttcgtaaaattaattttaaattattaagatatatattgaaattgattttaattaaaaaattaaattagatgcgtgtccaataaaaataaataattttaaagataaaattaacagacccaaataattaagcttaaatgaaccaaaaataattaacgttaatatattcagcccgtttttcaagcacgagccaacccgccccgctaaaaaagggtcgtatccgggtcaggctgttgagcatcgtcattgacgaaatgacgtcagcagagacaccattaagttttcttattcggtttccggttgagcaagaaaccgtggcacatcaaagagaacaaagcattatataaatgctgacaggtgccttacccatccattaagaaaattaaattatttatgactttttcttttttttacagttttcttatcatattcataataaatattttttttattaaccaaagactttgacggtaataccaattcggaagtgcaagcgcagagagaagaatgaacaactctattatggcttttgttctgctaatattactttcggcgttacgctactcaagcgccgaacaagctttcgatgttcgcaaacatctttccactgtctccaggtctctcttatttttgttaaatcgttgattcaacaaatttaatgttctttttccacattttagtttgcttgttctaaaacattctaccattttttttatgggaattttgtatgcatgtttgctgaattaattaaattgtctgtcttcattttctccccagatatggagttgtgaaagacatcgctgacactaacttcgtgccttctaaaatccccgagggatgtgttccgatccatttgaatctcgtggtaattttctccactatttgaggataataatactcattgattgcgaagaatgttttacagtacattcaattgttgttgtgactttcacaagtgtcacaacaattgttatattttatttttatgtcgctttgttgtttctttgcgcgagaaatgtagaacagtgttgaatgaaggcttagtattttttagaatgtttgggttgttatgattgagatttgatagtcttgaactgtctggtagactggtaatacttgacttaattgaagaggatgataatactactttacttacgcaggcgaggcatggaactcgatctcctacaaagaaaaggataaaggagttagataatttgtcagagcgtctggaagttcttgtaagggattcaaaagagcgaaatttgcctttccagagagttccttcctggctaaatggatggaaatctccttggcatggaaggcgtaagggcggtgaactaattaccaaaggagaggaagaattatatgatcttggaatcagaattagagaaaactttccaaatttgtttgatgaggaataccatccagacatatatcctattaaggcaactcaggtgagtttatcttcaactttttttctttgtccaagtagattttgatgttttgatttattttgttacctcaatttacaccactagatagttttgggggttagtaaggaaacactagttgatccaaagcaaaatattttattaaggtattttgagttgatgagcaaatgctaagatgagattctgattagttgcagcattattaactgcaatacaagatatggacttactttcttacatttggaagctacagatatatttaacctcacacatccctcttatatggaaataggttccccgggcatctgctagtgcagtcgcatttggaatggggcttttcagtggaaatggaagtcttggacctgggcatcaccgagcctttgctgttacaagcgaaagccgtgctagcgacattgtgctgagatttcatgattgctgtcataattacaaggtatgttgtagacatgtagtcatcattgatttctaaggatttttaatgcaacacttgcaagtgtgtcctgacaaaatttcatgtaatcatagaaattataggtagccattttcgtatgtctatttgaaaatcttcttgttatacattatgtataatcatccaagttgaatatgtcaccctttttaccatgtaatttttgatgacattgagcatgcttctgtgtctgctcaactgctcctttcattgataaatttgtttccctagtgctggaaggtactttgtgtttacagttttgtcttgctgtgctattctgatggaatttaacatattttaaatgaattaatatttccatatttgcctcatgtaaaggtcatcattggttgaatatgaaagttgtcgtttgttttcaagaggctatctgaggtaattgataggcagcatgcataatcactttttgctaaatatttgagcatggctttatggttaattggacaaattgcaatcttcagtggtagtgtttgtgctttactttcagtacctttttttgtttggttatataacttcttgagttatgggagcaggcttatcggaaaagccaggaatctgcagttagtaaacttaaggaacctatcttggatgagattacatctgccttaattgggcgccatgggctgaattttacgaggcaggatacatcttctctctggtttttgtgtaagcaggttattacaatttttcattcccagctccttttggtttttaccgtgtactcttctgagttcacaaatttcttttctttcttttcaattgcccaatttgtggttattttcacaggaagcatccttgttggatataactaatcaagcgtgtagtcttttcagccctcttgaggtacttctgtggtcatgatgtaatgaaatttgttatccaatcttaacactttcctctttgcttgtctgtaaatatttaaatagagaaaaaacttataaagatgccaggaaattacttaatttgactttatgatatatgtaaggcacgttttgaggctttgatgcgatgtttctacaatatgttattgatcttgtgataaaactgaaaattccattcaaatgtagttgtttttccacttgtgatcaattccatgttagcttatggctgcattttattatgttcttgctagcgtatgctacatgtttattaagattgtaattgttgtgtgcacagattgaattgctggagtggacagatgatttggaggtgtttattttgaagggttatggtaaatcactaaactatagaatgggactgccattacttgaagatgttgttcaatccatggaacaggctatcatggctgaagaaggtaggttagttttgtactttttaagtgtgtactatatatatgtcttacatgccatatcctgttagtgaaacttgtattatgtgtgttgtgtgtgtgtgtgtgtgtgcttgtgtgtgcttacacacaagcattcagcatcatctgattaccattgacattttacctgtgttttctagtagtttgatcaaacaattatcttttgaaacaagaaatctattggaacatatttagctaaggaagtcattatttgttagttgtaagtacagcgaaaaaatgcctctaattctagaacaactttaaaatgtttgctgctatataagaaaattggccatattaattttacacttgtctttgtgtacattcaccatataatttgtgttactaaatagcatgtaatttgcattgtttcaatttatttccatggtttgtctattaataaactgggtcaacctcttaaccccatgatgattatatatacgttttgcgtgtgtgtgtgtgatcactcaatgtctgttggttgaaattatagctaatgcaaaattagcaagggagttatttttactttacaaatggcattctgaagtctgtctcttgaatatgtgaaccttttactcatttccactttctcgattgcttctgtagaaagacatgttcctggaagctttgaaaaggcaagacttcggtttgcgcacgctgaaactgtagttccattctcatgcctgcttggtttatttcttgaaggatctggtgagttttttatactctttgcttgaataaatgtgcacagaattacatatttttgttttgttttttctactaacaagtagtgactagtgagagagagtgcttatagatgttctcttttgacaatgtacagagttaaaaaaaattcagaaggagcaacctttgcagcaccctccgaagcctccacagaaaagaaaatggcggggtagcactgtggccccttttgctggtaacaacatgttgatcttgtatagttgtcctgctccagacaaatctaccagcaagcactttgtacaagtgttacacaacgaacaccctgttccattgccagtaagcctttgtaccttaattttaccaatggtcatggtctggggggtcgtagggtttcacttattgtttaaaatcatattgtgatgttgttcatcaataactcagtttttgtgtcatcgtgtacagggttgtgatggctccgatttctgtccatttgaagtattcaaggtacttgtataatcccactataatgctcaatatcatcaaatgggtattgggtaacattaatttcggaatgttgttttatattctactatttttaattctgagttttctcttacacaggaaaaaatagttgcacctcatcagaagcatgattaccatacagtctgtaatgaaaagctagagcaggagccctcgggcaacaaggtttttcaaatatttcagtggcttttctcaccaaggaaaggtgataagtaccctaaaaatgaactttagtttgtttcctaggaaaggagcctcaaatcttacgctcttaataattcagacatgagcgcttattccttctagcagataatcaattttacttagattgtgctgccagtacaggaatgcctttgttatcttaagcttgatgcccgagtcctcctcgtctgtagcttctaacattaagagaaattgggggtggaaagtttagttctaatttattttttttccttagtagcgttactcttagtactcggctgatacctcagataatgtagcttgatgtgtcatactgtgcacactcttagtttcattaactgtctcttgaactccatttttgttctttttgaatagtagataatggaccaggtaacctttgactatacttatgtttgtgtttttgtgtttcttgttgcagctgttgataaatggtacgatttaacgagacaaattagtctagtcatgcatgaatcgcttccaataatgtttcgtgagtagtaacgtttaacaatacttttttgaaccggaacctttattagtgacaaccaattttctcatagtcggatcggtcattgaaccgatgaagatagtcttttaaaggttaatggttcaattggaaccgaaccaaacctgggttgaacttgttttactaaataatttgtttaatattttaaaataatgtcttaattatattgaacaaaaaataatattatatattaataataataaataaatttcacttaaaagtgtcattaattataaattttttttaaccaaagcgatatcgttttgataagttaaaaaaaaaaacggttaatacaagtttttaactgatttaacgattttaaatcgatgtaaggatccattaatttttaggagctcccactggcccgatttggatttcatttcaaaaccatggtgacaacacactctttcattgatttgtttacagacggcttctaccatcggaagcatgtgtaggtcccccatcgtgggaaagaaatatggtacgtatgatgcaattttattttgagatttgtgtgggactacggtaggaaattatattaaaaaaaatattgtattatcttcccccttcgaactcaattttgcaagacaactacgcttcatgtgaacggattggcttcatcattgaagcaatgtgcgtcggcggcatcgataaaaggatgacggagaagacaaaggggagatttccagaactgcgctgccttgaagcgttgtagtttgtcaacatgaggtgttaccgctggaggctgattcacattggtcgttttgcgatggggatcttgttttgggggacttggcctccatggaagctggaggaaggatgcaacctcctccttgttgcagtggtgacgacactcgatttgcagtcttcaccattggtgtgaaacttgagaaactacggaggcgtaggacctcaacttcaaatgatgctaggcttcacgatagtttcacaaattacaagaataaatttctcttgcagtaacacgtgctttaacgtaaataaattttatgattgagattaattaatacaaattaactatatttaatggttcaaaatcaattctattaaattttaaaataaatgtgcctttcttcttgccagctgcaaccgaatttgtcttttctggatacatgtagagttgttccaacaaacaattggtctttagccccaaagagattccaaattttaacgaaagtctttaacaacaagactaaggttatagataaattgtaattttagggatcttttagaaatttgaatacttttccagaaatttaagtgacaaagaattacatcaaagttatacttttttttaatcatcttattggtacaaaatattcatcaaattagttaataattaagttttatttaagcactaataccatttttagtgtaatttttctcaatcacattttttcattcataaaatttaaattaaagaacttatttaagtacaagtcaaatattactcgaatcaacaatttggtagtattgaaatataacaaaacaaaaacaccttttaaaagggtaattttgtctttttccatggaaaagttgggagtaaacttagcaaaaacaagcagggtgcctttttggactgaggttgatttttagacaaattaagagcccaagaaggtggaatctatttatctctagggagtcggtttgcgctcttctttagcaacgcgaatcgtgagtccagagtcccacagaagaaaaacaaaaccctcactgagcgctgctgctttgagagagagatggctccgaaccttgaatgtcgtatgtacgaagcgaagtacccggaggtggacatggcggtgatgatacaggtgaagaacatagcggacatgggggcgtacgtgtcgctgctggagtacaacaacatcgagggcatgatcttgttctcggagctctctcgccgtcgtattcggagtgtgagcagcctcatcaaggttggccgcatcgagccggtgatggtgctccgtgtcgacaaggaaaagggttacatcgatctcagcaagcgcagggtctccgaagaggacatccaggcctgcgaggagaggtacaacaagagcaagctcgtccactccatcatgcgccacgtcgctgaaaccctcaacatcgatttggaggtactggcttcgttttaaagtgatgaatgatttctaatgccttattgattcaatcgttgattataataattgtaatttgtattgtgtaagtagattttgccatagtctattgtggataagggacctatttgtgtgtttaggaggaggaaaagcaggttgggttgagtttctttaaaattaggttaaacacacaatttagttcctatacccttcgtggattctcataaaaacttattaaagtggttcataagtgagcaaacgcaaatggtttgatccctacagttgtgacgccgtctctaacagtttgacattaaccatttaccccattacgcatcctttgtttggtctctatgcgtgtagtgcattcttaatttggttcttattaagaattaagaatgtgttacgtgtatccagcactacacatatacacggatcaacttaaaattaagaatgtgtaaggggttaaactgttaacttaggactgtgagagacggggtcatgaatgtcgggactgaattggtaacatttccacctacatgtatgagactaaattatgtgtttaacctaaaatttaaaatgatcgctgaaatttcttgatgtgattgctatttatttttatgcaatgtttctttattgtttccctttatatttctgtatttgctcactttttccctgcaaagcatgttttctgattacttatgctaagtgaaaaggattatagagagaaacccttgcagaggagtgttatttagaatagggaataatagtctaaatacgtgtgtaataaaattaatacatctaaagaagtttgttagttttatttctcggcacttttgtatattttccttttcctggtgctactatttctttttttttttttgtcgaactaaattcaaatggctttgtgcaggagctctatattcacattggatggcctttgtatcgcaaatatggtcacgctttcgaggtagggattttttttttattctttaatggttctctgattgttgtagttactgagtaaacttcattccatgcaggctttcaaaataattgtgactgatcctgatactgttttaagtactctcactcgtgaagttaaggaagttggccctgatgggcaagaggtatatatttttatcagagtaaaactgaccacatctcacaactcacaagtcttgtttatgactaaatatattttttgttgttgcccataggtgactagtgtggtgccagctgtatcagaagaagtgaaggactctcttgtgaagaatattagaagacgaatgaccccccaacccttgaaaattagggcagatattgaaatgaaatgttttcaatttgatggagttcttcacattaaggtatttgattatttgtattccttttgttttttactttggttccttttcttttaagcatctaatttgttatatgaatttttattgcctatagcttatcttccaaagtattctcaggttttataatgatttgattatgcaggaggcaatgcgtaaggctgaagctgtgggaaatgatgactgccctgtcaaaattaaacttgttgctcccccactttatgttcttaccacccagacactggacaaggttagtgcaattttaacataaatcttgattatgcatataatttttggatgtatgaatttgccactgctgctgcattgtagattatgtttgagggcatttgagttgtagatttaggttagtgattgtttaacccattacgattgatgtgtaagccatgcattagcaaaaaatgattaatccctgaacattctctcataactctatatcttcaaaatcaatgcagtgttgtaaaattatatttctctgttgtgggttggtaatgttggtttttaaagggagtttaagtaaaaaataaaaaactcaagtgagtattggtttccatcatattttgagtgtgtcagaagttacttgaaaatttttgctttttgtaccaaatttccccacgtacccctcactatctctcttgcagctactgaatattatatgtattgtgtttggtctggtttctcctgtttcctaatgagaatagatatcttttatacgggaactttttttaacctaatgcctaatgttaataaatctagaagttgtggtttctcaagaagccattacttttgttgttataagcaattcgtacttgagtcatgtcttgtctatgggtactgtattgataccttgcagagattttaattccaattgttataggaaaacatctggaaagattttaatatcacaactgttatacaccataacatgtatggtatttgaaggtaatttgtgtattttgttacggtctggacaggagcaaggaatattggttctcaacaatgccatagcttcttgcactgaagcaatagaacaacacaagggtaaacttgtggttaaggaggcagctagagcagtgagtgtcaacttcctctacatttcttttttatttatcaactacatattctatccatgtacacaatttttgtccatctgcctttggatcctcttttctatcgtttgatgtcagtatagggagagtagaattctactatcttattttgggaggtttgacattgctttgtgattcaggtgagtgaacgtgatgataaattgcttgccgagcacatggctaagctacgccaagataatgaagaggtcagtggtgatgaagacagtgaggaggaagaagatacaggaatgggcgaggttgatgtggataatggtgccgggataacagagtgacaaaaaacttgtgggtatagtagtaaggcatagatagcagagtccggctttactaattctgtcttttgttttttttttttcttaattcttttcaaactgtctttaaatgcggttgtacaatacaagcttgaattactttatgttgagatgtcttgtaacttacgaagcgattttgaagtttcttgatgagggtgttcaacccgaactaaggagatttacagttacttcaaatttaccatcgcctttctcttcccttgtgctctctactcgcctttctctgattaattgttgaaagcaattctgttaactacaagcaattattacttgcgatttctattttctaaatacttggtttactttccaaagttctattggaagtcatataattcagtttataagatttggttattaggtgcgtaaataaaagatttaatttagacttggggagaatcaagctttttattatctggatcaaacagtatttgtggtggtatataaacaaatgtttgcaaacggaggtcgggcaacgtttttttatcattattattttagttgaaatcaattcaaagccatctaataagagtggaaatttaataaataaaaatacgattaatacaattttctgatttacaataaattttaagtatcattaaaaatatttaaaagaattttttagaaaataggtttaattacttatttggttcatgtaattttatcatttgtatcttttagtccttataattttaaagtgatttttttagttcttaatttgtaataaaaaaaatagttgataatttataactaatttgtagttaattatatatatatatatattatatattatagtaaggactaaaagataattaaaatataaactatagagactaaaaagatcactttcaaattatagggactaaaagaaaattaaaatgtaaagtataaggattaaaaaatccttatagttttaaagtgatttttttagtctttatcgtttacattttaattctcttttagttcatatagtttgaaagtgattttgtagtttgcattttaattttcttttagtctttatagtttaaaagtgagtttttttagtctctatactttgattcccttttcatccttaccatcacaatatgaataatattatcaattataattaactaaaaaaaacattaacaagtaatttataactaatttatcgcaaaataatttgtaataaaaaatagtttataatttataactaatttataattaattatttatgtatatatttttttgtagtaaagactaaaaataattaaaatacaggaactaaaaagatcactttcaaactatagggattaaaagagaattaaaatacaaactaactacaataaccatttttaaactataaagactaaaaaaaattaagatgtaaattataaaaattaaaaaaattactttcaaattataggaactaaaagatactaatagtaaaactacatgtactaaataatttaaccttgaaaatactacttcacacagcagtatatacaaccatttgaaaagttaaattatgatataacgtaatggtaacaagaaaaaataccaacgtgtgatgatagtgtaaaatttcacaacggggaataaaagtatcaagaggtcagtataggttacttagttgaaatttcaatttcgattggaaaacaacaccaaaaactcttggggaacttcatttaagtttgctaaactctttgaaagtacaaaagagagggagattgatttgggagccgagggataaggcccaaggtggattcttttcttcttttctatattccttttgagagtgttacatatttgctttatggactgcaggtgactttttctttgactgtttcagtttgttaaatatgtgcgcatcagtcatttagtgacacctttaattcaggagcaagtcatttagttactgatatctttatctcttatttgttagtcagtattgaactttcaactattataaaatctaaacgttgttgatcaataaattatcagattccatatttctccctaaaaatattccaacctgcattgcttcctcttcttctctgtttcatttcttttctgccatatttccaacagagaggaaaactcttactataatggttttagtctaagaactaagatatttgaatctaggtaactactaaataaacaaatgtatcccgcttttcctacagattgatgttttgttaacaagggataaaattctaggcctagaattggccttacgaggaaaaggtgtagaaaatgacttaattagtatcttacacatgttctgctgagataactagatttggatgtagtttttgaatgtttcctatgtcttgtagttttctgaatgacttatgttttatgccagacactaccaacaatccaatggggacagaatatcagggttgttcttgatgttggttgtgaagttgctagctttggcggctatcttctggacaaaaatgttattgctatgtcatttgcaccaaaggatgagcacgaagctcagatacaatttgctttggaacgaggaattcctgcaactctttctgtcattggaacccaaaagttgacatttgctgacaacggatttgatttgatccattgtgcaagatgcagggtgcattgggatgcagatggtgcttcttgagttccattcttctgagttgtgttcagacttatgtccatatcaggacaacctttttctataattgacttactagttctatttgtattatctttatgacaagagtgtttaggattcttagacctggtggtttctttgcatggtctgccacaccagtttatcgggatgatcaaagagattgggaagtatggaatggtttgtccctcactctctatgcatatgcctcttttgtcatttgaaaaatagactattttatccctctctggggtatatacaccttattgaggaggaaaggagaaatgagaagggacgaaagagaagtgaaagatgtgaagagaaatttttctttgaaagaactatagtttatgatttcttgaagaatgttacaaaacatgcaaatttttccaatgatggatgttcttgttgttatccttgttttctgcagccatggtgaccgtaacaaaagcaatgtgctggactgttgtggctaagactcttgattcatctggaattgggcttgttatataccagaagcctacctcatcttcctgttatcaagaacgcaaagggaacactcctcctttatgtgaaaataacgatagaaaaagtatctcatcatggtatataagctaaagtttttggttgtatttctttgacatttatatttccaccaaattttatttctatgcaatgccaacatgcattgagtaaaatttttgctgttgtttttatgatgctttagctttttgatatgtgtattcacggtatgaaacggcgtgacattttgcatcaattttagcatatgttgttcaaaagaagaccatagaaaatgatcatggaccatatcactgttactgttagtttaacttctatatgtgctaattttcttttcatgattgtggttaggtatgccaaattcagtagctgccttatacctcttccagctgatggtgagggtaatatgcagagctggtcaatgccttggccccaaaggcttaccagtatacctccaagcttatccattgaatccgatgctggtgagatgttcttgaaggacagcaaacactggtccgaattagtttcggacatttatggagatggtctttctataaactggtcaagttcgaactataatggacatgaatgctggttatgcagggtaaagtatattcaattgtagattagctttattatgtcactctgctttgacatttatgatccagagtgttagcaacccattttttactacactttttattattagttaaagtttattaaaaattataaaatcacatagagattcattaattaagtttagagtcttccaaaattttataattttcaataaatttcaactaataaaaattgtaccgctaacatttctctttaggttcacatatacgtttgtcattacaccaactcgaatttgctgattacctaataccttccaagttttctttgaactgataccatgcacgtttttttttccctcagatttgctgcatcactcatttatctatcaatctaggtgatgaatgtagtacccattgacatgccaaatactcttacaactatatttgacagagggctaataggaatgtaccatgattggtgtgagtccttaaatacatatccttggacttatgatcttgttcatgctagctttatcttcaaacatcttatgcaaaggtatacatattgaggaaactaatgcctagaacttactttatgtgtctagtgctttgtctttttattatttagaactccattagtttagtactcctatatgtagcataaacgtgttgattatgattctcacagtttgcaataataatctttttgccagatgtgacattgttgatgtggttgtggagatagatcgcataatgagaccagatgggtatctcctggttcaggactctatggaaataattcacaagcttggtccggtcttgcgttcacttcattggtctgtaacattgtctcaaaatcagtttcttgttggtaggaagagtttctggcatccaaggccgtagaaactgaatgatcaatagggttgtcaatctttttattttactcttctttggcagtgatgactaatttttatatataccattaaactatgagagtttaatcattttattttactctaatacatttataaactaaaaaattgtacatcaagtttaaggaagggatgccgataaaaaaattaaaaaaaaaagtttaagtatgaaaatatgacagggaaaccgttaatgggaattctcacaattaataaacaatttaaaataaacaatattttgtgagaaatatcaaatgtttaatggggaagccgctgaaacatttaaattgaaaaataagttggtaatgtaaaatggtgctctgggtaaagttaagattcaaatagataactatgtgaatgagtttaatataagatgaataaaaattctttctgctaacttaatcaaaagctatttttcatttttttagatttttttataaataaaaaaactatttggctcaacttctccttttaaagaaaaaaaaatctaaaaaaaaaatgggtctaacacccttttagaatttgacggaaatgcttacaacaattttataggggacaaatttaaaagtataattttgaatgaacatgaaggtagttaattacaatatcattaaattaagcatttatctttattaaaatgattaaatctacactatgcaaaataaagtccctactatgtttaacttctatgcatataaaatcattcttagaaaaataatatttaatgatttaaagtaaagtctagaaaaatgcaaatacatgttactgtccattaaaataataataaaaactaataatattaattactgtgtaactacagttgtcttcatatacttatcaatttattaaccaaaaaaaatatacttatcaatttctcattaataattatagtttattttaaacaattctgataatataaatataaaatatgattccaaatttttatttttgtttattttcgcaaaatcattgccatcatttactaatcaatgacctaaagagaagcatacaaattaaaaatttaacatgcctatttttaattttataaaatctctgttattaattactaattaatgatttaaataacatataaagtaaaaaatttagtacattttattgttcttcaaaataattaaaaattgatataaaaattataaatatttattactatttaattataaatgtctttaatcacttttcaaatttaaacttatggttatagtttgtgattctagtcttttaaaaaatttaaagaataaagtaaataaatttgattgttgatttaaaaaatcgataattaatattcctaaacgttctaaaatattaatcattgattttctcattaactattgatactacctctaattatatttataagaaacaagttgtagtataaaatacattacaactttttttaaaaaaataagagcatatggtattacttatgtgattttaataataatttaatttaaaaatttatatttaaatatttttttacagaattatctaatcagtatatgataaaaacggtttatgttgtaagaattactttaaaaagtatatccaaaattatttcaagtttatttgatagtatataaatctctaaattaacttatataaaaaaataaacttattatttaatgatttaaagaaatataaaactaaaatgtaaacaaaactttatttgatgaaaaagttaaaacttctactgctttccgagacaattttaagtaccatatttaaaaagtcagaccttaagtcaaacactaaagatttttgtgcaaattagccacaactgtaattttgctttggccagaaagttaattacacgatgaggaagaattatcctacaatagtagaaatgattataatttcgatatattattaaacatgagtaatgctgtatttttctacaatttttcttataatttttaatattctatgaacaaagtactaaatgaaaaaagtaaaaatatttaatgatttataaatttaaaggggtttaatattttctttatttactgtgtagaaggatttcatgaatattttatttggtatattattaaaaaaatattttttttactataataacggttatatattaaatgagtatccactattatacaccacatagccaatcacatttataaatatgtttaatttattttataactggttaattattattagatatttcagtaatctcataatacaactaaccatttgtaaacaaagttaacaatttttagatatttcaataacctcataatattattaatcagaaattaataaatttatatatagttatatttatttacttttaatcgctcataatatccatgtttttggggtggacacggactggaaaaaaaattggggtatgtccgtatgatgatctttatccatattaaatgcctttagtaatagaatgatgtatattatgagtataatggaaggaaaaatttataatagttaaatttcttaatttattttcttttaaagagtgatatatattacatttatttttttataaaaatacaaatttgaccccctttcattaattatacatatttgatttataattttaaataattttatttatatttcttaaattccattcaaaccaattatacctattctgtatacatatacatttttttcctttatattttttcttcttatgttgtacattgcttcttctacatttttcttcctttcatttcctcgtaatcttttttcttattttgtacatccctttcctttatccttttgttcttgcttagttgctttgtacattggttgtatttataattacttaattttctttacttttttaatagattcacaccagacttctttttagtatcataacattttaaattctaataaataaataaaatattgttttcaattttatttttaggattagacaataaaaattaaaaggtccatttggggtgaatataaatatatttttaaataaatcacaagtacttcctcttctcttctataagaaaaagaattaatttcatacttattagtaaaataagttaattttattaaattatattaattttaattaaaaataaacatatttttctaaattattatgcattaaaactcgatattaagcaaacaacctgttgagtgaaagatattttaaatataatctcattaaataaagtaaaaatagacaaaatttacttaaaaaagagaaaataaaattgtgatttattcttataaaagagaatggaaggaatacattttactatcagccgtgatattcaattcaaataatattattatgagtgataaaattatttttaaaaaatatttaatgcataattcaaatttaaattactagttaaattgaaataattttttgttagtggattcatgtactagataatttatacaagtatttttaatataaaaatataagtatttacaaatataaaataaaaaataatattgataaaacatgagtgggagaaaaagaaaaaaaaaatatacacaaggttgagaaaaagaaacatgctaatcattaatgacgatgacccttgccttaattgactcattatcgggacatacaccgcagtctcttgttgttctttccacacacagagcagagtgagagagtgttttgtttcaatgtggctaccatggcgtctacgaaccacagcttcgcgtccaaaccgatcccgatccttccccatcccctgctcttccttcaaagacatccaatccatcctccaatcccaaccccaacctccctctctcttccgccgccttatcgtctcgccctccctcatccgctcctttagcagcccccgcgccgccacctcctccatcgaaccgcctccggactccgaccgttccgccgtcgtcgtctactacaccagcctccgcgtcgtccgccgcacctacgacgactgccgcgccgtccgatccatcctccgcggcttcgccatcgccatcgacgagcgcgacgtcagcgtggacgagcgcttccgcgaggagctgcagcggatcctcgtccaccggagcgtgatgctgccgagcgtcttcgtcggcggcttgtacatcggcggcgccgacgaggtgaggaagctctacgagagcggcgaattgcacgagctgatcggacggttgccgaagtcgcagaggaacatgtgcgatttgtgcggagggctgagattcgtggtgtgcgacgagtgcgatggaagccacaaagtgttcggagagaagagtggtggattcaggagctgttcgtcttgcaattccaacggtttgattaggtgtcctgcatgtttcgtggtgcagccgcaacacaccaaataattccattccctcctcttctcttcttcatgttgaacttagatatattcctttaatttttcattggtgatgatctctctgtgaattactcaatttagattccttcgtaaattctcaattaaaccttatgcaagttaggacttaggagtatgatactatgatgtctggttagtggttttgtgtatgaagaatattttactcgaaagaaaagacaaaaatcattttgaaaggaattaatctccaatgaactattgatcgagggatatcccaaacagtcctcaaatttagtcacccttcaaatccaaacatcttatagatttttttattttatttctatcatatcataatatttatgatacttatatttttctctctttttattctttatttccttgcatgtgtaatagcattggggagtttattaatccttttcaatttcgaaaacatgattttcattgaaagattgtgaaaaatttgcgcatctatgaatttttttgagttgcagaagtctaggtgaattgttcaatttagcaatgggatacaaactgacatcttcctcgatacgtagcttgtttttaccatttttttttttatcatgatattgataatctaatcaatttgattaagaaacacatgctctcaccatttgtatcaaccgtttttttttagacttgcctttacctatccacttatacatatatatttcataaattacaattctatgaaattatattattatatagttttaatgtttaaattatttttttaagagtctgattagataaaaaaatttataaatgcttgtaagaaaaaattgaaataagttttttataaactaaaattagtttattcataagttagaaataattttttgaagaaactaatagatagaaattctagcttatgaaaaactttttttctctcataagtaattatctaaacatgtcttaagaggtgtattgtgtatcacttcctctcttaattttgtattaaatcaagggaatatatttcaatttttacaaataaaaaaaattattaagaaaatgttattttgggtcagatagatttagacagtccagcccaaatgagcatttttgtttttgtttggctagctcaatagatcatgaaacccgaatggagctagcctcaattggattctggtattctgtttcgttattttcgtcactccagagtcaagtttgaacttcatattgttttttacaagtcaattttgagtataagtattcaacttgtccccattagtattcttataggatgttggatgcacatgaaatgagaaaagataaaagataagaaacaaaaatgggaaaattaaaattttattaataaaatttaaaatttattttaatgttggaagactttgatttagtaaatttcacacacacacacatatatatatatatatatatggaaatggtttttatcgatgtatcaacaaaagttgacccaaatagtaataatttatattttttaatcaagtgatttaagatttcaatcctaacattaaataaaaatatatattaaaaaagattaattgttacttttgaatatggttacttggtaacagtacaatgatcacttgattagtaaaaaattaatgtggattgcatcaattcatataccttttattatttttttattagataactttatttcaaaactcaccattaaattaaaaaaatattattatatatataatatttataaaattttgagttaatctaaaatatttaatgtctcatttatatgcattgtaatatatactttttgaaatatatgaaaataagaaccatttaattatccttatattattcaatttttggtcaaatttggtacaagtaatctaaataatatataattaaagtttaacaattagatcaataaaaaaaaagacattttacataagaataatttcaaatcctgttttaatatctttatactaatatcttatttgttttatatagtaaatattgatttttttaatgtttttaagacattgaatatatttattttttacttaatgttttcttgtaaaatattagaaaaaatttcaataaaatatagcattactttttaatgatactattgataatgtaaaactaaatgtagtgtaacctgtttagttttcatgctgaaaaaaaaaatgtagtgtaacttacatcactataaaataattattcttggaggaataacatgattgattattttggataggcaggggaacgtaaggttaaatgatttcacatggtaataggattgaaccataaatgagatctaaagtaaaatttaataaaaatattttactttaaatatgataattatatattaagttttttttatcaacataaatggattttttgtcaatatacatgaggtctatttgttttataaaaattaatagtaaatttttttataggtctaaaatttaagttttaactattttattcttggatcgacttgcatgataatgatgaaattgtatgcttaatcgttagaacagattcaacagaattacatgctttcgtaggaagttccacaactttaaatcatagttgatgccaactcccccgggcctcgcccccaatttccaatcgtattatcaatggattaatatctatcacatgtttgttttggtctgttacaaattttataaaatttatattcactttcatttatttattaatttttcttaatgtgtataaaatatcataacaattataataggacggaaaaaatatatatgattgggaaggaaagcttcattagatgtgataagttaaataatttaattgagattagttgtaataataataaaaatctttagaaatgcagcttgtgatttggaggttgtgatggatgagtttcggtaccgggtttggtcatggtgcaagataaatatcaaaggcttcgatccatctttgtacttatggagtatatatagatccattgaattgcttgatgcaattatcatagcatgcaagggttctgaccttggataattatagacaggattgtgattattttatctataactagctgattctaacatgggttttggcactttggctagtgttttggaagggtaggggttgaaaagcacgtacacgaacacattattggattgtttgtgcatgtaacatcgggtataggttgttggcactccttgtggcaactacctccaatttatcattcgtttgatttgaatatatatatatatatatatatataaagttctcaggaaaaaaattaaaataccatttataacagtataataataatgattagtcgtcggaccttttgaataattgttataatgaggaactacgtgtaaaatatacatattttcagtctatataccaaaatctaagacttctagataagttagcaatataaacttcttgatgtttagatcatcatgtacttactttcacatagtcattttgacttatattgtcttaatacgtcactgtaagactacgcgaacttgtatagaagttaagattttccacaagaaactaacataatgattttcaaataaattatatataatgtaatcattttaaacctttttcattattctcgatgaatttcccattcaatattttatttggcgtgaaaagaaaagtttatgcgcaaaaaaaaaaaaaaggaaaagaaagaatgaaagaaatttaacaccgacccatggattttgccgacatatttcagaaacgagagagatgaaatggcccttatgttgaagagtaaaaataaaaggctaatgatgactatggtgataaattttatatgcaaatcaattatgatcatacgaatttgatttcttataatgtatttttttcctttttattttattatccaatcctcattttcctttctacacgtaagaccaagacctaacaggaatctttctttaaaaatcaaaagtgtcatgaacacgagcaaaaggccaacagctacgtacgtacatggtagttcatattaacaaattatactaccatcattctgttggaaaaataaaataaaaatgaaggaaaataaatacgaagaagatgcacagtcttgaattaaataacaaaataacagtagtaaattaaatttaattgacaacacatgaataatgcattataacatacaataagcacaagaaaaaaaaaattaggggaagaaagatataacttgggttgaagcgcgtaaacgctatccttagagagaaaacgcccccactgtacgggtaagaaattctgattgcgctcctctcccaagatacgataatccgttggttccgatcgtgtgcagcgaaaggatccccaaaccttatgaacaccaatgctcttgctctcacaaaaaataagttttttatagaaaaagaaagagacaaatttttgggagaaagaaaccagagctctcagtctgtcctttctagaaaagaggaaagagatatatataggcattttgcaacaacaaaatatgaccgttggaaaaccaacctacagttgtcacaacaaacataacaaactagttgactcattaaaacaaaatcttaagaaaatctaaaataaatattttattttataaaatagaattaatatatatttataaattttaaattaaaacacaaatatttaccaacattcccccacataatttaaaattttaaaatatattttctaaaagataatttgtataaaaatataagagtaagagcatgtgatattgtatttcggcataaggaaccttccgggtttgagccttatacctagtgtttatgaacttccatccgagaaaaatgtagtgacttgattgtcttgaactacatattctttaaccggactttagtacacaacccctacaatattggcgttcaattaggttctaatcagtggtagcacgttacacggccttgcgcttgtatcttgtttcgtgagtgtcctttagagattagcccatatctcacattggcggccccaccaccacactcactaggtgaatcctcaaagagtgagttgtgaccctcacccctacaataattgtcatcggattcattaagaggtattttgttttttttttataccaaaaatacacatatataaatacctcaaccttaatattcccacaatttataatacacctcgtcataggaatgagaaacagaacagcttcgtcaaatttcattttggtgtactttagtcaacgaacaatttcgttgttacccgttgaactccattcatgggatcaccaatcacacggagacgggtgtccattgttgtaactaaataatgggttttaatctcattcccctcgacgactcaaatacttgttgacacatcaacccttttgtaagcggatccgcaatattattttttgacctgacaaagtcaagagaaatgacatcatgagaaatcaaatttcttatagacttatgtgtcactcttaagtgtcttctttttttcattaaaattttgcttgtcactttagatataacaatttgactatcacaatgcattggaattggaggtatacgcttatttaacaatgacaaatcacataatacatttttaagaaattcatcctcactagtagcagtatttaaagcaataatttttgctttcatgtgaaataataatttgtctagtagattatcatgatactacacagctagctaaagcaaagacataaccacttgttatttttatttcatcaaaatcagaacttcaattttgtatcactaaatccctcaattacttttcaatctaccaactgcatgtgcaatatcaacaggcctagagaagtttgtcaaatgcaacaaagatccgatactttgagaatatttatgtgaagaaatttctttactcttttttttttttaacttgatggatgagtcataaggagtaaaagcatgtttcgcatcaaaataattaaacttcttcaatagcttttcaacatactaagattgggtaaaagtcatgtcatcatttttctttataagcttaatacccaaaatcacatctacacaaccaaggtctttcataccaaaatttctaaacaagaaaaacttcacatcatttatgaaatgcatattactaccaaatatcaatatgtcatccagatacaaacataaaatgacgcatccattatcatcaaattgtttcacatacacacatttatcactatcattaatttgaaaatcatacaaaagaataacttaatcaaacttttgtgtgaatgctttggagcttgtttcaaaccatacaaagatttaacaatttatttttcaagaaaaaatattttcaaagaaagtcacatctctagactccataatagtaccattagaaatttcagatacttctgaattaataactaagaatctataaatagtattatgtaaaaaatatccaacaaaatataattaatatttttttttcaattttccttttcttattaatagagatattaacctttactagacacccccacactttaagatatttcagatttggttctctttttctccatagctcataaagattttttttttgtttataaggtactcttttaagaatactacatgcaaaatataaagttttaccaaagtgtttattttattattttgtgtgttatatttccacaggcttatcttttatcaatgagttataaataaagagacaatcagtcaacatgcaacaacaaaatacttgcagtagtaataataacgttaaacaataaaaattaaaaaccaaacaacaaatgtcctgatttttaaagacttgtgttcacaggatcatttgaccaagtaaaagatagttttctaatcatataggaatgaaattagaagtatgcttttagtttttcacataaactaattctaaaagcattttctcttcaaaaccatcattaataaagaaaatatattttaaatttcaaattataagaaaatatttttcaacaatctctcactaatgtaaaatttaaggaaatgaaataatataataaaacatttttaataaagcataatacattgtgtcttcatccattaatttttcaaacttactaaaaggggagtcaatcatattcatgacagatattttggcaaaataaaatgctattgcagaaaagactatgcaagaagaaagtgataactaatttttctctctaagactgttggaaaaataaaataaaaatgaaggaaaataaatacgaagaagatgcacagtcttgaattaaataacaaaataacagtagtaaattaaatttaattgacaacacatgaataatgcattataacatacaataagcacaagaaaaaaaaattaggggaagaaagatatagcttgggttgaagcgcgtaaacgctatccttagagagaaaacgcccccactgcacgggtaagaaattctgattgcgctcctctcccaagatacgataatccgttggttccgatcgtgtgcagcgaaaggatccccaaaccttatgaacaccaatgctcttgctctcacaaaaaattagttttttatagaaaaagaaagagagaaatttttgggagaaagaaaccagagctctcagtctgtcctttctagaaaagaggaaagagatatatataggcattttgcaacaacaaaatatgaccgttggaaaaccaacctacagttgtcacaacaaacataacaaacaaactagttgactcattaaaacaaaattttaagaaaatctaaaataaatattttattttataaaatagaattaatatatatttataaattttaaattaaaacacaaatatttaccaacacattcttctctaatttttactatagaacctatccatcgtattcgtatgcatcgattcttcaaactagtgcctgcaagtccacatctgtgtgcatatcatgaaaatttatgtaagatataataccgaatatcgatcaatgatttatattatgataaggaattcaactccttaaatattttttcaattctttaattaatttgttattaactcaataagatatattttattttaattaattttcagatatttttattatattattattggacataatgaaatagttgtaaaataacagcgaagcaatccattaaccaatatatatatatatatagacacacacattagtcacatgccaaatagtgggcaaatctcactcatgcaaaaacttcaaacagtgaaacaatttgatttttgttttccttttggaatcacgacatattattacaagacaaatacattataacttattagaagtgctacttcttggcaagctctattcgaatcgaccatgaagtcttttaccaagtcttgagagagacttgatatattatatatcatcatttagtctcgccatgggtgcatgataggctccaaaactcgctatttcatcatcatcattttatacgaaaacattgaccctaaaggcacaacaacgatatactattctttcttttattatttccataaaacataatggggaaaaacttatctcccaattttaagcttgatttgaattaagagtaaatagagaagataaaaatattgatataaataaaataaaaatttattagaaaaaattcattgtttagtataaatgagtaaaaaaagtaaagaaaatattgtcaatttgtttggctaaatgaagaatatagtataaataaattataatcacgtgggaaagataagctgcatcaaccaacagatgcatagctaaaaaactaggaatactaaaaaaaaaaaaaattcttcctacagtatgttaagtattttcagaccaattataaaataatttttactctattatttcttaacctaaattatttattagtgttttttaaaaatatttaattatttaagaaattaaaaaatgaaaaagatagataatttttatcacattccatgccaatttggagaaaagtgttttttgttggatccatcaaaataaatctaatgaataatatttgcgtgttagtatatactatatgtcatttttgtagtgtatgtgttttagaaaaatgacaaatcatctctaaaatatcataacatttttttccaatatgaattaacaatttttaaaaaatatggaattaacaatcttcacatctttaaggcgtaatcttgatttaaaatacaattttagtcataatcacaatttaatactctttctaattattttaaaaagaagagaaaattcaaattctcgtctaaaataattaaacacacgtgttttcttaatcatagtattctaaaaagtatacttttatttcttccaattattttaaaataaaaaagtcttgtacttagtactctccatctaataattctcataaaaggacagccaatctatttgcatgatgggcatgtaatttacaactcataagtcagcaccgttaaaaactacagttggaggcagctcggagcttggacccgttccatcttgtgcaatctttaatgttgtagggattttttttatttggtttctttaactattgtgtggacgatcatgtttaaaaattattttcttcgatcttaattataagatttttaaaaaaaattgtttgttgttttttataagattttttttctaacttctaggtatattaattattatttttatattcttacttaattatttttttctctaaatattaatgtgaaataattaaataaatagaaaaataaaaaaataataattttagaataatagtataaataattgataaatttaacgtgattaattagtttttaaggaatgctagttaaatgagaactataattgaaaatggagtatgtaaataaataaaattaatttattaaactatttaatatcgttaatataatgagtttaatattaaacagatctacacccacaacttgattcacaggaatagaaaaatgttagaaatatattttttttatacaattttaatataacatttattatcaaatcgaataaattatagtttatacatttttaaaaaatatacttactatgatttctcattagtcaatattgtaaaactttttacattagttttattattgaataaaataaataataaaagttatattatcattcgataaaaattagtatatatatatatatatatatatatatatatatatatatggtacaataatatatatggtaatttgcttaattattataataatcattttaaaaatgatagttattatgatttctcataagcttatcgtaaaaaaagttaaactaatttttattatagattaggcacccataatataaatccttttttcactatatgaaaaatttatatatatatatatatatatatatatatataaatatatatatatatatatataattaatttttacaataattattttaaatattatacgtattacaatatctcattactttacattgtaaaacattttacaatgaaaaaactcctagattctataaatattttcttttagagttacaattttattacacggcaactgacgtgtcggagttggtaacattgattttcttttttttggaagatgtgtgtggaagttacgtttagattgaaaatatttttaaataaaaattctattgtgagggaacgcgttttcaaatatttttgtattgtagtaatttgtatgggtccaaactggttttcttggtctaagaacatggtttggagattcatccctttggcctatttgacaatgttttagcaatttcccatctttcgatactttcgaaggctgattcttttggattcaaatcctttcaaattcgtttctttgaagaaaaactcaatctgggtcgtgcttttttgcccgagttgacgttttcaggcaacaagaatgagcaaaaactggaaatctagctgcttcagggatcctgggggagttctcttccttctggcgttgtgtttattgtttcagaactttagtttgtgctgctctttgaatgaagaaggtattggaattttggtttgtggaattttgtattctcgtgaggttaattgtgtgtatctgaggggaattaaagctgagaagggagttctatgtgcaggtaaagctcttttgaagttcaagcatggaatagtaaacgacccttttgatgctttgtccaattgggttaatgatgaagtagcagttaacccctgtaattggtttggagttgagtgttctgatggaagagtagtggtcttgtaagttctgattttgtgatgtttttcagaaactgaatatatgtagatttctgttcaatttaatttatgtccagaggcagaacaaaaaaatgaatgttttttcttcttttcttttctttttttcattagggtcatcgtacgagagatccaagtttaaaatttgtgtattatttcttcttgtaattagcaaaactgtttgatccatgatattttgagactgttaaatcaaattactattgttcatattgttggttagatagtattagcatcatgctgatcatgaggatgtattttgtttggcaggaatttgaaagacctttgtcttgaaggaaatctggtacctgagcttgcaaaccttgttcacataaagtccatgtaagtaattgcttgttaccaatttgtgttatttattgcagatttgcagctacttccttaataatttcagtttccaattttcaaatgtctaatagtattgtgatgactttgttgcagaattttgcggaacaattctttttatggaatcatccctgaaggaattgcacacttgaatgaattggaggttttggatttgggctacaacaacttcagtggaccactacctagagatcttgggaataatatttcgttaacaatcctgtaggataatactctttgaacagttcaaatttcatttttcaaacttattttcctactgtgtactcagtttcttcatattgcagtttgctggacaacaatgatcatctttgtggtttctctcctgaaattaatgaattgaagatgctttctgaatatcaagtagatgaaaaccaactaatccgtgcagaaaaagtgccagcttgtagaagatccatcaaacagtatgtcattaagcttccaaaaggggtcatctctagtttgtagttatgagccatgagagtctttcatgtatttctgcttcataatcttaactcttctatcattctttttgtgaaggcaatcaaggcatgttggccaaaataaaaatggtgttcagaggctactgcaaactcgtactcacgaaggtggaagtccttttaatcgtgtttttcctgttagtcctgctccatttccttcagctcccccacctgccccagcaacgccaccagtggttcagaagccagctcctgttgaccgaaataattctgcttctccttctcccctgcctggaccacgatctgcaccgctatataaaagtagctcatcaaagaaccatgtagttgttattttggctggagttatgggtggtgctgtatttcttctcatttcaatcattggcctatatctctgtaaaacaaacaaggtagctactgtaaaaccttgggccacaggattaagcggacagcttcagaacgcatttgtaacaggtaaatcttagcagtttaaaagtagttaagtggagcaatgactgaaaacagtagttaactacataaccactgcttcaggattcttgaaatgtgacaaaaaaaaaacttatttgcattaggtccttgttaagttggtcatctaattgatctggcttgaatgattgcagtattgcactcccttgactgagctatgttacttatgtattgcatataagatttctgcctccgtacatgtatgacagaattttacattttcaggtgtgccaaagctaaagagatcagagcttgaagcagcatgtgaagattttagtaatgtaattggtacttcatccattggtacagtgtacaaagggactttatctagtggtgttgaaatagctgtggcatctgttgcagcgacatcatccaaagattggtcaaagactttagaagcccaatttaggaacaaggtactgccaactaaaacataaacaatttcttttttagattttcaactaggctgctattgtaactaacattttaagcaattatggtttcagatagatacattatcaaaagtgaaccacaagaattttgtaaatcttcttggacattgtgaagaagatgagcctttcaccagaatggtggtttttgagtatgccccgaatggaacactctttgagcatttacacagtgagtacctaccatttcggtgctattattacattggaaataaatcaatgattgagtattctgtatccctatttatggtcatcaacttttaatttgttgattttacatacttgctgatcatcaagttttccatctattgatactctatacattcagttcattggagcttgtgctattactctaatattaccctgtagttagttaggactaatttgctctcagttttgctataacatcacttcttatcatttggccacccagtaaggcattttctctgactcattgtacatattataacataaagatcctttggtctttcaaccattcaacctatttagcgtttttgctataacttgtcagtacagtttagaacttaagtatatttaggagagcccaaaaaactgcagatgtcaactaactagttttataatgctcattgcatccccaacctcctgctttctaggatggtgcaaagtaactaatgatagcttgctagattagtagctctgcaattaggttttgaattatatttatgtgagaaattaagcgtacaatatttttgaatttatatgcttttcccccctctggtatctacttcccatgtttccttttctctttcaaagcaatagttgcttttaagggcttttttttttggcattctttgtgttgaagttggaaactggctgatgtattcgatcttgttgtgaattccagtaaaagaatctgagcacttggattggggaacaagacttagaattgccatgggcatggcttactgcctacaacatatgcaccagttggagcctcctttggtccttagcaacctgaattcttcagctgtccaactcactgatgattatgctgccaaaatctctgatttgagtttcttaaatgaaatagcttcagctgtgataaaatctcctgctagaaaaaacactgacatgacaccagcaagtaacatttacagctttggtgttatattatttgaaatggtaactggcagactcccttattcagtggacaatgatggctcacttgatgactgggcttcacactatttacaaggggatcagcccctcaaagaaatggtggatccgactctagcatccttccaagaagaacaactagaacaagtcgatgctttgattaaatcttgtgtccatcctgatcaaaagcaaagaccaacaatgaaagaagtttgtgtgagattaagagagataacaaaaataacacctgatgcagctgttccaaagctttctccactttggtgggcagagcttgagattgcttctgtaaatgcaagctgaaatcggtaaatcaggttgtaagtatggagttcttaccttcctcatcctttttccatcggtgaaggcacaaaaatgtattcacctgtagattaatacatcttgtgttaattatggaagagaggcaaatcacatgtacataagggagataaaagaatgcgattttttcttttcttttcctgcggtgcttcgtttggttatggtttatgaaattatactaacaaaaaaaagtttcacatcagttaatttcatttgctcagtgagtttatttggtgaattaaaaatatttttaattatgtttcttaccagttaccaccactatgcatttctctccccacttccaacttttactattttcataaacaacataagttgttctgagtaacaaatagttgaatcactgtgtggtatgattgacagataactttgtcttttaagcttgtgatgatcaagggttcatttctcataatcatgtacatgaagaaatatatgttaggagaattcaacttcttaaatggatcttggaattttgagagattagtccctgattcttggctaaagaaggatactctcagttcattaacaacaacaaaaaaaagttctcagtaatcatagtcatacccatgtgtgttgataaaaactgctaggccttcatttgcactttgttgaaagttacatgtgataaataagaggccaggttaaggttgggggtgtgatatttgatgttttaataatatacatggacaaggtcaaagtcttatgggggccttgctaattttctatgatgaagtatgaatgaagtttgtgagcaaatgacacctataaagcacaaacttccaagctgtagcctgccaaataaaataacgggcggcagaaaattccaagggcagctgcatctgcatggctgactgggtgaatatgacttggtggcacttgttgtaaacgacgattgcttttgctataggacagttgccaattgaagataacaaggttcttgaccttaacctttgcattgctcatcatcatgctggaaaaatcaacgactaaagaaaccgtatgcattttagaatgtaaaaaattggtggtgtctatatcattactaacttcaattaaggaaaagagtgtacaggtacaacaaattttgaacttttcatttatttattaattggcatttgtgtattttgaaatcttcttatttagtccttaatgagttttgaactttaattatgattaatccagtagtgaatttataacgtggctcaatctaaattttttatttatgacaactacgttctttaatatgtttattgtatttgtcttttagtatttaacaaagatatagagaacaaatcttcaatttagttttctaaagttatgcgcgtcactacttccaaattttttaatcatatcgtagcactctcaatttaaaacatcatcgtagtattcaaccaaggcttctctcactgtttttgtccttgaaggatttaatttagtactactaaactagttcctccacagtttaaaatagaggactaaagtgatgataaaaagaatctttgacagacaaattttgtgacatattaaatctttgagagattaatttagtgagcatatttttggatgaccaaagtggtggcaaaaagatctgagagactaatttggtgaccaaatttttagaatagtttttatatagattttttttttagaatagttatgcaataacacataattttagaggactaaattgaaaatttaatcaagtaaaaattaatgttgcaataaaataattcaaacaaaaattcatttgatattttagttgatcaaattattataatatcattaaaaaattattctcaagttttatttatgtatttcattttttcttttaaggattaaaaatgatataaaatgaataatttgataaaacaatgcagatagcatgcaaataattatgattgcgccatcgtctgtaagctaatgacaattattgcaattgatagaatattcataatttaggaagtagataaaaagattttaaattttacgatatccattttatttacaaaatatttttttatagttcaaatccagtttttctttcaatttggttctcattgatccttgtccatccataataaattgattttactgtttctacttttttaaatatttaagtagttaaactcgacaaatatttggttcgttagacattaatttgaaaagacaaacgatatatatatacataaaaaacaatatattttttgttccatcattttgcttgcatgatttatttattttacgaattggacgatggtattagtagttgtgcataaactacaatttagataacacatactatagatccaaacatgactaggggcgtgaaaaggggatttatgttggtagtatcatccgccctaattaattaaacaaaccattttttttatatagatgactggaaatggtacctttttttcattttttttatataaaattctatttcaacatttaaacttgtaaagtataatttataatactaattttaatcaatattaacttataatatttgttttaatgaaacttactgatagaattggaaataaaaaacctataggtcagtcttatttcataactaaacaaaggtcccgtgtcacacacagttattgatataatgaacctacatataacatttatataatgttctacacataggcacctacatataacatgaaaatgtacatggcaaaaggtggccttcacgtatagatataaagtatgagatttattggcagcataatggatggcacgttgatgtgcttcattgtcaattaagcccaagtcaagtccccccccattaccaatgagctatcagctatatatatcaatcaagcgaatgtctctttaattggcaagcctttatctctgaactcttccaagtcccttagtatacccctcaaggaaaaatggctggtatgcacttcagtatcctttctctactgctacttctggtggccttctcttacacagaagccagtgcagatgttccaaaaacaacagacaagaaaatagaggtggtggtggaagccacggtctactgtcagagctgtgaccactttggaacgtggtctttgattggagccaagcccattccttcagccaaagtgagtgttacctgcaaaagccacaatggtcatgtgagctactataaggtctttgagacagacaagaatggttacctttatgcaccacttgaagggttcaaaatgcagcattatatacttgaccaccccctccactcttgctacgtgaagcctgtttggtctcctcttgaaagttgcagcctcctctccaatgtcaattatggtctgaatggggctccacttcgttatgagaacaagaaattgcatggaagcaagtatgaggctgtcatatatgctgctggacccttagctttccgtccttctgaatgctcacagactcaccactaatgtctcaagcaattacctttgaccatgcattgagatttatttgatcatgattttattgttgcctattgtttgtgtctacatagtattcaatctgaagatgtttccttttgttattctttttggtgtattccattttggtctttttctgtattaagctaaattgcaatgttattgtggttatttaatctcattttattccttaaaaagagaaatggttttcattcgaatagtcagaaaagtcagtagaaaaaggacaaccgaaacctttcattcgaatacctcacataaaatcaaattctgcttacatatcagaaatcagaataggcactcagcaatcaccttattcctaaaaatccagaggcatgttaaacatcttgtttatatcatctatggcttcctttgtgaggatagttggctcaaacaaatcagattccttggactttcctagcaattttggtggtggtggaggtggaacttcttgttcctggagctcatcatcagcaaggattgaaaacccaccaatgtcatttcccctaatgctctggtgggccttctcctgcttggtggtggttcttctcctaacaaaatctattggcttcccaaacatgttatttatgtcatccatagcttctttcaagttgatggtggggtctactaaaccgtggtggcaaacattttccacctctggttcatccaaaatggcggaaccaacaaatctgcaaacgactgtatcctctctgaactttgaattacgatcgctatcagcatccatatcactagattttttagaaggaatatccttggagcgtagaaaaacaaagccatttggttgtgaagccgatgaagtacaaccaccttcaaacaaattcacatcactggtctcagaagtctcttcatcatcaatgtatatctggagcggttcttggtgaggttggctagcttcagtcctgttccgaagtgacaaggaaccggatggtttgattccattgtccaagttttcatcaaccaaaacctcaaactcgttctttgtactacgatcttcttttgaatggtttttatgtgatttcttgcctaatggaacagtctccaatggctcccggaacatgctgttaatggcattcatggcctccttcatatttattgtaggatccactaatccatgatggcatgcatcttctgcttcagactttccaaccatggcagtgtcaacaaacttgactacaactgtatcatcaccacaaaatctcttgcgctcatccttcttagtctttatgtttttatcatcagccacacctttagctgcataattatcaattcggggtcccttttgcacaccctcaacacagtctactccattgcttttgcttccctcagttttgttgtcaagagaagggaagctctttaaagacagaggcctcctggaagcttttgcttcctgatgctgcaggagattccttctaaattagctaactgaataccactaacaacaacaacgagatgcctaaaacaacacagatgtgagcacatgaagagaaaaagcaagtcattacctggattctcttattattttttcgctccatccgttgaagaaattgttcatatgatttctgcaatttatctagaggctctgcaaggctgttcagaaaaaaggcaaggtaaaaaatgactttggaaatttctgggatagagaagcatctcatacaaattggagtaccaggttttgctaagctaaattgaatgagaaagtaaaattcatcgaaaatgatgcatgcatcaagtttcaagcataatctaacagcaacttcatctgaattttctgtcccaatttcacagaagcatcaaacactgcaaaaaactgaatgggacacctgatccagtcaaaggtgagagtgtttaagctaaatggttaaacatagttagcgttgcatcttagtcatatcatatctatgaaggaaagattagaataaaagagggatgcctgtcatgacactgtgcaactatcgacaaccatgttaactttgttcgtacaaagttcattgctaagttccatcaccactcatgtactcaacacaacaatcaaaacaagatgctgacggttacagaatacgacttacttcttcactcccagatggtacattttctctgcctcatcgctcttcttgcttttctcgtagtaaagagcatacgcttggtagaattcacaacgttttgtcccaatgtgattagtctccatcgttctcaaaagtgtttttggatcatccacaaaatccatctaccaatcagaggggaaaaaatcactaaccatctcattaccccattgtaaaattcgctaaatccaataatccaataataatgatataaaaaaaaaatctttaggcttcatttcccgaacccattcccacaaatcactaaaagagaggggaaagggtgtttaggttaccaggtggagccaaacccgaagatagcgcatgtcgtttctgtaacgccgatcgagctcgaaggtgtgtgcgcatttctgcaggaacgcgggtaacttttcctttagggttttgggaggaagagtgtccttcacctttcggatcgcgctgcaagtaaagttgggaatgagtgaggaaaccgaaaagtgaagtggaaaacagaggaatggagagagagtgggaattaaagggtaccgaagccatggaagaagagggtctttgccggtgtaggcgtggacgtctgagattaaggaagataaaagttcatccacgttcgccatttctgaatctgcggtggcggaaacggttgtcgtcgcggtggtcctgatttgaattttagtctgggcgcggctacgagatgctcgttatatcgagattcaattttatttcacttttttttgggttgggtaatgggctggcccactttatttccaaaatggttgggcccaagtccaactaccacagaaaacattccgaatagcctgatttctgcatgatgattttttttttttttatgattctgcatgatgaaatgaaataactaaaaaaaatatacataatttggtccacacattttttttttccattttgtttctaaaatcacctttacaaaaaaaaaaacatccctataattagtctcttcaaccaacccatatctcactcacatactaaaaactatccgatattatttctattttattatttttatttttcaaaaaatttaaaaacacacgggatgctttttcccctagtttttaataaaaataatataatgaacaataaattttactcttgttaagattattggatggaattcaagctctcgttataatataaatagtgatactggattttttttttacatttataattacttgaattgaaagaaaattggatagtttagaatgttgatgtaggtcatcaaatgtagtagaattgaataattcatgaaactagtataaacaatgaatcttttgtttttagtttcaagcactaaaccttatcatgatactaattactaacctaaaaggcaatatcctaattttcagttaaaccctaaatataatcaaattactttaacaaaaaaaaagcataatcaaattactttaacaaaaaaacagcataatcaaattactttaacaaaaaaacagcataatcaaattacatttgaactattcaattctagtgcatttgatgatcacggatattctatccaattttatttcgtacagaatgaatttaacttcaaataattattaatgtacaagaaaattcagtgacactatttatattggaaatctaatgttatttttaaaaataatataatttttatattttttttatgtaattacatatatttatcttataattttttatatcaaaataataccattgtaaaatataaatttttacatattaaaattttcatttttcaacatgagagaaataagtctggttattgaaaagaaaagcaaaaacctggtgcgttgcttctactcacacttccttcctcttcagcccaccaaggaaactgcttccgaatctgatcaatggaaaactcagacgagcaacttcccttctctccacaaaaccctaacaatgccgaagaagaagacgacgacatcgaagagccagaagacgaagacgaagaagaggaggaggaggacgacgacgacgacgacgtcgtttcgcaggagcaatccccattgtcgcggctgcgcgagcagcgttcgaagctggaaaccctgtcccggcgattggcgtcggagctggtcccaatccgagtccacgacgtgctgattcgcggcaacacgaagacaaaggagtgggtgatcgaggcggagctcaagctcctcgaggaggccaccaacgtgcaggagctcattcgcgcctccgaaatcgccctcgccaggctccgcggcctcgagattttcgacaccgccgagctcacgctccaggccggtccgccggagctgcctcacaccgccaatgtcgtcgtcgacgtcgtcgagtccgccaacagaatctccggcgatttcggcgtttacaccaaacccgcggtacaattttgctctctagtgtgtgttatgttgagattgcactagattgaattcattccaagtgagggaccgagagatgctagtgttatttaaggcgttgtaaagaatttttagttaatatgagaatgctttttcacttaggtttgaggttgtaatttttcattgcagatgcttgtagccttgtttgtactatagtgcaaacagcaaatctgtaatcaggagttaggacaatgaccataatttaagtgactatgacatgactgcattttgaaggaacgggaatagcactgtggcttgttatcagagaccaggggttggtcctatatggccatactttgaatggaattagtttagctttattattttgcagttgccgtaaaaatgtcatttcctgatcgttagctgtttctaccataaagtcttggtttggttaaattgttgagaaaacatattcttcctgccgttgaggttaatgtaatcttctagtatgatctttgactattctcagtcgagacattagacatatattgaactgcttgtgccaagattatagagtcaagggtttaagggaagcagacttatttcccccttaataatatgaaagattttatagaattagagcaaaacaaactactatgtaccattgctttacttcttggctattgatattatgcatagggatgagcaggagttagtttgcatgtttcttgttttactattttgactatttggtcagagataaggtaagtatttgaaagagtatacttaatgtggaaattgggaagatactccaaattcttggagctccaatttgatttttctttctatgagtggagtttttgtggcttttggtcctttagaatgattatctctatttctaatgacttctcgtggtaataagacaatcaggatataatgtatgtgccattatataatgttaatttgttgggatttttaaaactttatgaggttgcatagatatgatttgttgcctattgataaaatataaaggtttgatcatgactatgaattttcagctaaattttttttttccttgtagtggagtagaaaatttctgtttcatccttgttttattggaagctgtatattgattatctgagtatttattggtcttaatccgctaccttttttttcatgttggaaatgttgcaatgctctttcagactagttcttggtctgctgaaggtggtcttaagtacaaaaacttattaggttatggtgatctatgggatgcctcgttggcctatggtgccaaccaaacaacagaggtaagtgtaggagtgtatgcccctcgactgaaaggattgttaaccccctttgtagcacgactatccatgctttctcaagattggcaagagttttcttcatataaagagcagttgctaggcttgtctctaggcttaatctcaacaaggcaccatgacttagtctacactcttggatggcgtaccttgactgatccatcacaaatgtcatccaggtctataaggaggcaacttgggcatggtttactatcatccttgaagtatacatttaaaattgacaggagaaactcaccaattaggcctacaaatggatatgcttttctttctaccactcactttggtggccttacaccagatcatcggagcttgcgatttctgcgccaggtgcaatacatcattttcttgtcctttaattaatttgccgaaatgcaattgtatatgtcatgaataaacattataatctctgttaagtgatagatagcactgtagtaattacaacaacaacttatccccctgagtgatgaatagcaatgtagtaatttttgaaatgattttagtatgctctactttccaaattgatgcagaccagaaattttaaatgaatttatcgttataactatatatttgtaattaattaattattgtggttactttaatttggaggatttgattgtgtatagatttttattcccaaatttatttccttgtaactccctatttgggacagtctcattagagtctatatatttataccaatctatgtattttttggaacaacagaaaataatttctgattctttatcctttccaccttccaaatgaattagattgaaattaaggatttggaatctagggttaaaacatccgattcttttgggtatgggcagagtacatcttcttgggcattttaaaaattctgaacctggtgtctgtaacaatattcttcttttcctatacatgttgacatcatttagttttaattttgccggttgtagacaatgtatgaggagcttgtttaaccagagtgtggcctctccaccaagtgaaagaatgcccttgcttgctttgcctgagtaggatgctcatacttgttgaaaaacagcctatttcgttattctcactatttgaaaaatcatggcactagtgcatgattggttgcttatggtttttgcttctttcataggtgttatattatatatcgtgtgtatcaagaaatcatatttttctaactttattgtatatatagtgcaattttgttaccacctgcctgaaaatgctttggactgtggtaaataatatatattggggaatggaaaattatccatgtattctttaaaaaaatgttgggaatgatgacttcaaggcatgttcagtaacacatgtataacgagttgtggtaataaccctcatctgtctaaatatatgttgtattttctttgctcattttttatatattttgttttcttgactaacttgtttgactctttcaatgcaggaatttgatgttcgttgtgccatcccctttgggttttataatacggcacttaaccttgggatttctgccggtgctgtttttccatgggggcatggcttcatgaacaagccatctccgcttcctgaaaggttttatttgggtggtgatttctctccagtttgcacccttggaggaccaataacattgtggggatttaaaactaggggattaggtcctactgaaccacgaagacgaagtagagatggaattattgatgacagtgatgattcctctagatgggacttcattggaggagatctagctgttactgcatttgcagacctgtcttttgatcttccaattaggtggttgagagatcatggaattcatggtcatgtttttgctggtgctgggaatactgctaaattaactcagaatgaatataagcacttttcacctcggaagttcttagaatcctttcgaacatctgtgggatgtggatttgttgttcccactagactttttcgcctagaggttagtttatgtttcagtttctttatagtttatattaattgagcaggggatcaaaggaaccaatttttttttggggggtgggggaataattgaagtgaaatgttaatgatggagggatacatagaagactttgggaattgggataggtagtcttatttcttaaatttggactttgggctagttgtgtaatttttctttttattttccttaattttgggtctgaacttagcacttaatcttataaattatctgcaacaatatttgatccaagttttgatattgttgcaaatcacctgaatataatttatttatttattttactctttcaactatgtactgataataatataatttagagaaacaaccagttgtggttgtaaggttggcaatgtttgacaaaattatccaatctcttttctgatgtggcacttacttgacctcccttctaatttggtatttaattgttatttatcaagactttatgatttcttcattgacacacttctaattgtttcagggtaatttctattacatactcaagcagaatgagcatgatcgtgggaaaactggatttaggttcagcttctcggctccttcttagtgattgagtccacagctgagattctttttctttttcatttattctgtagcattaaacatttttgctgcctgtcaatggatggctagtactcttcttttccttctcgtttaaaagccagactgaaatcgggaaagggcactgttccagtgttgaggatttataggatcagtttttggaaaagacattacccctcgagacatataagccgatgctcattgcatgacgatggtgtatgaaattccaaattattcgctcgtgtattgctactttagaaggcctcgattggcactgagaattctcaaactttgtttgttcaacttaaattgaataaatcgctaacattcgttcagatcattcttgtggatatttatgcctattgtcttccaaatggtaaaacagcaaattgactttgtgcttgtgtacttgtatatttgatgggtggttcctgaaggtatacacgggttaaattttgattttctgccaatactatttgtgctaacaatttaattcatgtaacttaagccgaagtcattcctaatccgagctggctcaggagatcttaattcataacctaattccaaaagtgaaaaatgtctaattattaatacctcctgaagcacgcaaaagcccggaaaaggaagacattggatcagtccctatattaagaaaaaggttaaatcatctattgtgtcattttcttattgagatgatctatttatccttgaaagtgttagattttgtcatttagttctctaaaattaagaaaaatcaaaagaattcctgaattagcaatctatttatcacattaatcgaagcttgagtgataatattaatgtttcttttagtgtaaaattaattacttatacttatatttcagtaaagagatagtatgttatttatttttatggcttaattatttatctagttcttataattttcaaatttatgtataagtggattttttagttcttaaaatttatattttaattttcaaaaagtctttatcgttaaaattatttaattaaggaattaaaatataaacgttacaaactaaaaaatccacttattaactacaagatctaaaaatgataagtttgaaaattttataaaaactaaatgaataattaaacctatttttatttattgttgacatgccttgacacaattgtacttaaaaaaaatgttaataagaagcatactttataccttaatatttttcattatcagtggattttatgtgagattcacataaattttaccttatataaatgttattgttaggaaaaatttaggagaattcaaagaagagatgttagagactagttgaacaaaggttgagacatacatcaaaatatatgtgatcaagtaaattgtagtactcaaagatggcattaacacttagagtgtgtttagtcaagatgatgaaaataaaaaagatgaaaatacaaaaaaaaaaaacatttgaattaaggtaaagtataaaaagtgtgagattcaccttatttcttttttatttatctccttctcccctctatcaaacacaagcaaaggcttccgacatgcctcagaaataactaagagatgctaatgatcacttcatatgaactagttattattgaatgacatggaatgaaaaacatttagcataacagccatcatcatactctataatttcggctaattccaatgtcaaatgttcaattgagtataggtcaaaagcagctatgcagggacttgaagagatgaagcgttgaaagattaccaaaataaattaaaattagcaagaatctttaatactttgatgatgtctcatgcattagtggctagatactaagagaccaattgaacaaatcaattaataatacaaaaccttaagattttgatcatgatttcttcatcaattgaagaacgaagatggaaaggatggtgatgatgctagaaaggaggtgttgaactaattcgagaaaattcccaagaataagataaagaaaataccaacagtgactcatgtgaaagaatattgagtaagggctttatatccctttttagccctttttaaggttcgatcataatgtaaaatgaccctatgatgcaataagtgattatatgtttaaaacaataatttgtaaaaggctaaacagtagttaaaatattaaagttcaaatcatgattgaattgttgtagaagttgtattgtcgaagtcataagggtaaattggagaggagtttgaaggtttgggctcattggaagctaagtcatgccaatcaaatggtataaaagatgaatactccaaatctctacaaggcttcaatttcaaagtaaacaagccaaattctaagagcatgactatccaaagcaatatattactattttgacgtatacatgcatcacttgctgtaagatgatgatgacattgaaatatcttaaatgtgtatttgagaatccgtttgtatcattgcaaacggaaattcacatttttcaatgcacaaaaatgagaaataaaaatgtgtaacttttttgttgaacgaatatttgaaactttccaactgcaaaccaaaaatactctaaagtcgttaagttatttggacttgaccacgagaatctcaactctaaaccaaggtcttgactagtggataactgcctatgcaagcatcatcttattgttaatgacttcacttacaaaagtcatgatttctcacagtcaaatatcctcttattcttatgtgtgttatgttattatattgaaatcatttctaacttaagcattaaagtttcaaaatgtgtttatcacttcatccattttattctgccgtacccaattatcattgaaataacaacttgttagagaaatcactattgttcaagtataagccttgccatttgagtcacctcaaaccttataagaattaaattataagcaagcagtaaaatacatgtgtaagagaaaatggaagaaagtgaaattctggtaggcaatccgaaacgaaagaggtccacatgagaacattcgctccttgattcttggtatatgcttccagcatcttcctctcatccctcactcactccttcaatatcataatctttttattttctttatccattcttattctattcactacaacaatgcttcactccacttctctccttccccataataaccgcttcgtcttctccttccgctccaaaccttctttttttcattcccactctctctctttctccaaatttctctctcttccatcttcttctcaatcctcatgttgccacgtgtctcgaatctccaccgagaccttggaggtctcgccgccgccgcctcccgacttcaacttccgccgcgaaatcgcgcgcctcgccgacctccgcgacaggctctccgcgtgctctactttaaacgagaagctccgcgtgatcgacgccgactccagagtgaagcgcttcttccgttcccgccgcggcctcgctggggttttggcatcgctgcaattgagctccgaccaactgttcctgctcaagtgcgtggttgccgccggacaagagcacgtgctgtgtttgggcgaaacggaatcgttggaatcctccgtcgccacgagtgcagtgaagagcgcgctttacactctggcggatatgattgagaatatggattcctttaacggcaatggcggagcgggttttgggatggctttgggggatcacgagattgcggagttgaacaatttgttagagattttggcagaaattgagcgattctatgactgtattggaggaattgttgggtcagtgcttcgtttttctacttttaccatttgcttagtaaggaacaaatggaaaagaaaaaggaatgaaattaacttaccttgctttttgcttctttagtatattaataagtgaacagaaagtaattatattaataatattaccttgtgtgagttacgtggtgaagctgtagaacggaactgttgtgctttttaattagattaatatttttagttctccggttttctgggaacaatatttgtgtttgcgcgggagacaaggtgggaacaataattgggattagggttgtttagtttttttcccctctatccaaacgaaccggttcaccttgccctcattacttgtcatcccaaccaaggttttaaatatgtgtgatctatcgaggtcgttgctttgtcatgttccttgatattgtgggaaattgcaaacaaatgaggccgatgtaaccacaattgtggttgtggacacccggaaaaacttgatgctgcagctgaaattgttgtttgcagaccttttctaaaaccttgatcccaacaaaataaagtcttttttgcttttgcttggcaaaaacttggtttaataggagagactattgttttggaataagtcaatgtgcgtctgcttgtttgtttgctaacaataacattaataaatacactgcaggtatcagataacagtactggaacttcttgtacaaaaattgttcgagatgcagaatataagctgggcccaccagaggcatgacgtgaaagaatgccaaattttgggaattaatgcacctaatgggcttaacctttctgaagacacagagtatgcatctcaagcagctctatggggtatagaggttagtttaattacattacctgtttcataatttgcatttagatcgagatgattcatagctacctggaataataagatcctatccttctagggtttgccagacctaggtgaaatttatccgttgggaggctctgccgacagacttggtttggttgatcctaacacaggtgaatgcctgcctgctgcaatgctaccatattgtggaaggactttgttggaaggtcttataagagatcttcaggtatatagatataccactatcaaacacaatcatacttcttatgcccaattttttttaataaaatggagacaagattaatcatttatgctgggcgtggaaatatctaattctgctgtttcacatttgaaggctagagaattcttgtacttcaagttatatgggaaacaatgcatcacacctgttgcaataatgacaagttccgcaaagaacaaccacaaacatgtcacctctctgtgtgaaagactttcatggtttggaagaggtcgatcaactttccaattttttgaacaggttttatataaatctataccacggcttctcagaaggggtaatcttatattaacaatgtctaaatatctaatttgtacattggtagcctcttgttccagttgttggtgcagaagaaggccagtggctggtcaccaaaccattcagtcccttgagtaagcctggtggtcatggtgtcatatggaaacttgctcatgacaaaggcatcttcacatggttttactgtcaaggaagaaaaggtgcaactgtgcgccaagtcaggtctgttgttatgattgatatttctagggtttgcttttgttagttttctagtagagaaacttgcttttacaaggtgactgatactggtgaccttgcagtaatgtggtggcagccacagatttaaccctcctagccttagctgggattggcttacgtcaaggaaaggtaggtgtaggtgtaggctgttttaattgataatgtcattctttttgaggactctgtatgttgacaaagataaaaacatgtcataataaatgggtaaataatgtcttaccatgtgtagttccttaccttttgtcttgtaaaatttcttatgcataaagatttgggtaaatcaacaaatgacagatatttgcaactttggtgaataatataccctgggaaataaaaaaactagataccacagaccagagtcaatctgtttatcctttaaatgcactgttcgctactttgcatgcagcattatccctatttaatagtttttcttgcctgaagaacttaaaggaaaaagaaagatactattttctgtaatatttattgaactaaacagtgtcaaatcacaaattgaatgttaattgcactttcttaactgtgtctgtttaacagaaactgggatttgcatcttgtaagcggatcttgggtgccacagaaggagttaatgtgctcatggagaagaaaagtcttgatgggaactgggaatatggtgtgtcttgtattgaatacactgaatttgacaagtttggaattactaccggacctcttgctccaaaagggtacatgattttcctggacttgatttatttcaatatttcacctatctcataaaatttgatttgacctttcataatctaaactgacttaatatgttcaaatttggttccagattctgtgatatatgcagctttaaattatttgtaatgcttaagcagtggtatccttctagtgagacacactattacaaacaaataactttgatgattgagaacacatccccaaacttgtgtcaatatcgagaatggcatgcatcttataaacctgtatccacagaagaaccatacatttcattttaatatgaatgcatttgatatcatagatttcttttcttctagagattatcataacaattaaatagacatatatgtagtcaagataatcaacaattggattaaaataacttaatcctacctcccaagaggcaagaaacacgaatgcctagtcggaaccttattttgtgttcttctaatcttatttgttgaaaacagagacttgtttttgtttgctcaaaattatgtctcacctgatttgatggtgttggtttcaatttattctattagaaatttttattctgtttatattttaggctttctaatttggaatgcataacccaaataacaactttatttttataattaagtttgcagacagagttcccagccaatacaaacatcttatatattgatttgccttctgcggagctagttggatcaagtaagagtgaaactagtttacctggaatggtgctaaatactagaaagccaatagtttacacagatcagtttggaagacgtcataggtatgtattttcactatgaactttatctatgcagttttatttctttcttgtgttttgtagagtaaattgaacattaaccttagcacaacggtaaggttgcttgctgccttgtgacctaaataaagttcacaggttcaaatcttggaaaaaaattctctgtttgctgggttaaggctgtgtatatctactttcctcaaaccttagttagtgggagccttgtgcattgggttgccatttttcttattgattgaagtggtattattaaatttatattttctccaaaataacttttttcaaaatttcaaaatggatatattgtttaacagcagtagctactgaagcattttatattctatattctttatctgacactaatttatattcatgtatctagaaacagaaattttttattttgaataaatgacaaccacaagttgaaattgatgggtttcctttcctggcttaaaaataaaatgcatcctttctttctacagtgattatctgctttcttatttattattacttattggtgttagtaagagtagatttacagtttcttcaatttttctgtattggtcttaaattctctaagttggtttttggttaaattactcagtttgtccctaaactaaaaaaaataataattaggcccctgaactaaaaaagtatgtccctggggttagttttttatggatgcaaaccaccagaaaatgacaatttatggcagtttttaaaaccctcgagactcgattaaaaatattacatgatctagggaccaacttgaaatttcccaaatagtttatggaccaattgagtaatttaaccttaatttttcttgtgatgaaacgttattactctgtctatatcgctgattcttttgttgtatgtacaacttattcatcccttttttcattgtgattcactagtgtctctggtggtagacttgagtgcacaatgcaaaatatagctgacaattattccaattcatattcatccagatgttataatgatgtggaaggtatgtcatgcatcattcatgtatttgtttgatctgacaaaccatatgctccctttcccttttagttgtgtttaacaaaacccttacttaattgtgagcagataagctagatacatatattgtatacaatgaaagaagaagggttacctcctctgctaagaaaaaaagaagacatggagacaagtctttacatcaggtttgatttactgcatgtgcaaagtatcaattttgtgtctagattggggtgactaaacacattacatgtgatattccatcgtgttgattaaatttcaagctccataccatccttgtactgttatttctcgtccttttagcttcttattatgaggtttgttcctaatatttccttaaatacatggattgtgctcacttcacctagcagttggtatcatctgaatatcttactaatgtgttgaaagttgaagagccaaataagacgttatttgaagtactaggattatttttaagttccttaaacatttaccatgacaaaacctacaatttatgtcttggagttggaatgatgcttgcttttaaatatctaaaatgttttacatttatatgcagacacctgatggcgctctattagatatcttacgaaatgctcatgatcttctttcacaatgtgatataagacttcctgaggtatatatgtattctaatgtgttttatgcatattgatttgttttcatgtggttgggttgggttcattttcatattatactagtttgcttattctaggtactttcaattattttatgttacgctttctctctcctgcagattgaagctaacgagaactatgttgattcgggaccaccatttctcatccttctgcatcctgctctcggtcctctttgggaagtcactaagcaaaaagtagcactgtttatcatgttatttttcagtagttattcatcaatagttgtcatttttgcatttgtttgtgtatctttaaaattatggaagtttgattgaattctatcagtaaatggctgtgttctaaacttgttggttcttaaatggtgaaataaagtatccacggtctatttattaaattagcattttaatatatttttcttgttagtgaaattgtgttagacctgattaattaaatagatcatttttgtctgtgtccagtctccactccacccgtagtgttcaaacacacatgacaaagacacgaatattacctttttacacaattttcttcctattgtttcatcgtaatcctttcttcaatgcaatttgcttgaaacatgacagttctacagctttacaagggtgaattgtgttgatcatcttttatagaaaaaaggtttcaattattgtcattctttcttgtgatcagttttatggtggttccatatcagagggctccgagttacaaatagaggttgcagagtttttctggaggaatgttcaggtactacctgctcaaatcgactttgttaacttatatggaatggagttgctaagatgttgggctgatatttgtggtttgcccctttattccagctcaatggaagcctgatcataatatctgagaatgttatgggctcaatgaagattaatgagaacggtgaatccatactacattatggccaaaggtactgtgctgtctgtattaataagaactgttgtgatcctttatcaacctgatcttccgtccaactcccaagacctcaggcataaaattgttttagattgtaaacattaaaaaatgtttatacacatttatcttgttatcttgctaggtgtggaagatgcaaattgcaaaatgtcaaggtattgaacaagggaattgattggacttgcggtgaaaacatatactggaaacacgatgtgcagcgatctgaggtgctgcagatcatactgcatggaaatgctgaatttgaggctactgatgttgtcttacaggttaaagtttaaattcggattttattctccctctaaaaattagttgcaaatcttgcttacaatactgccaactcatttgatttgagccaaagatttcatatactatgtaagaaagagttgtcgttggatccaaaccaattggttagttgatatgaatgtggatgtgcatggtaagatgggcacaacggcctggtattgcttgacacagtaggatttatttccttcatggatacctaaccacactgttacaaataatattatagtcatgggacacttccttttgtatgcactgatataaaggatgccttttgagtttagaacttattaggtatctggtttttaactatccaactggccctgtagtcatttgtatatgaatgttgaaaagaaccagagtcttgtaagaaagccatcaattactgtcagttatacagcctaaaaaataagtaaaataaaattactcttgtaacatgcgaggaagagagagagagattggcgccaaagtttgttagaaagaatggacatgtgtcagctgatgcagaaattaagggaggcaggcaaagcatgcgaattaagaggccgaatgtgctatataaggattttgttaagaagtgaggcacggcatatagaatgaaaatcttctccctgatatctctgctcttcctctgattccccttgctgtgtttctatctttctgattctaattctcttcttagttccagcatgacgttatagtcatttcgtttcagtagtggtatcgcagtgtacttcaacttcttactaatacaaaaagcctattatctctccactatcgtagcaactcttctcgttaattctagtggatatttgatacctttaaactaataactgacaagcttatttgctgttatttaactgatatagggaaatcatgtgtttgaagttccagatggctacaaactgaaaatcacgccaggaagcccaggtctcttaaacttctgaaatttctttttgcttggttgtttatgctttagtttcctaaattaatatgtgctgttatcatgattattttgagaatgttagttttgtaatccttagtcaaattatatttgttctgtctagtcatagagtgttactgatttaagttcataattgcgtttcaggtttagcaatcaagttggatccaattgatcaagatatgatggagagtggaagctggcactgggattacaagatagaaggttctcacattcagctagaattagtagaatcataaaccactaaccactttaaatgtctgctgcgtgaatcatggttcacaactggcattggggttcattacctaaataatttcgattaccaagtgacaggttgaacagaagttaagcctttgtcacttttggttgttttaattgtaatatgttggtaggtttgtaaaatccgtgtcacttccctcgtgttcttctatttttccattctttacccccttttatttattgggatgatctcatgtaaccaacattgttaaactgagatcaattcaatcaatgaatatggatctatttcgttaattgcaaacctctttttgtatcctttgagattatcacatgcccagattacacccggtctctttttctggtttctgcctagagtccccctttagcatacgtgtttcctttgaactagctattattattttcataaaatattgataaattaatttttaataaaaatttatccacaataaatattttatttgtaccttgaaatactacacaactgggttcattattaaataatcctgacattttttcttgttattataacataaaagtgagaatattatcaaattactaaatagtgacaaaaataataaataatattggaaaacgatatgttttatcataattttaatatattaataaaataatattatttagcaaaaaagtgcctgcaaaaaagttcataatatttaccaaagactaatgaacactatttaaagttttaaaaaagtagttaatcaagataatatttgaccttaatggctttttgtttatcacactttttccaggatttacgttaatttttcccgttaaattccgtatttctcttctagatttcagcacaatattttttttttgtttaccttttcccttttagagctttctagtgaaacagatgttttaaaacttgggagtccattttgatttgcggactacactggctgctgatacaattcaatctgtaaattctctcaaaggtgaaagcggaatcaaaagcgaaaaaaggggagtttcgtttatgaaaaaacaaaacatgttgaattctttaagcactcgcgtcctctttaatccattaattaacgtctctgtcgcgtacatcatggtacaccatatatgcacaaaagttgtatgatcaatatagagatagaggtagctggaaatggagttttaaattacccggaattcatatgcagctttcctttggatgtcagccaattttccaactagaaattctgctgtcattttcacagcatctggaggattttcgtaacctgcaagatttgttaatattccccagctagttttttacactaaaatgttatagcaattaacaatccccgccaaacattatgttcaggtatacttctttacgtggacatagttatttcctcattttgactattattttcagcgcaacttgatagcatttgacaatatatgtacttgagaaattgagttggcatggaagattttatgtggaacattttaattccaattcacgaagctcccttcatatttgtatatgccaaaagccacataacggtcttttacaagattaagggtgttggtgatataatttgattccatttttagataaaaaattattccaatcaaatataaaataaaaatacagttttatgtggttcaattttaatatagaatcatgtgtgatttagtttgattcaatttgatgattttttatatttttaatatattgtcaactaaaactaaatttatatagttattatgttaaattattttaaaaatgaatttatttttttttattaaaatttgtttaatatattttagttgaaaattattatttttacttctatttggcaataacataaaataatattactaactctttttgtaacataataaaaatttgtgtatcatttgatatttaatatttttttaaaatagtatatccttttttaacataaaaaagtaaaatatatattaattataaaataacaaaaattaataaattattcaatacttattattaattactacagtaaaaatataatataatatgtggatttgattctgttttttataacaacaaactgaatcatataaaaaaaatatacagttttttaaattttttgttttgacagtttttttgttttttgttttatatagtttgatgatttatgaataatttaattcgattttgaacactcttatacagggttggccattgtcatgacaaaagagtatttttttctctaagaatttaattaatattcggggtaaatggaaatgcatcttcctgttaagctaaaccaaccgtggaagattcttatgatccagctggtatattttaaatcaaattaaagacatgggcattcttatttaagttgaataggattattatgaatggtaatttttttattgagttatattatacagttgtgtatataaaagtcaaattggaaaccaattgattaaactagaataattcatgtgaattaatctgatggtgttttgtcatatgaatgacaaataaataataaccaaagagaggggaaaacttgtttagttcccagttcacagaattctttggatcaatctgttaaagcccaattaagtaagtggaaatagatgtcaattggcagttgggctagtcagaccattttatgaagctttccaaaggggagatccaaattccaaagtttatcaatgcgtttgatttctaaaagggttaggggctatcggcattcttttttacatcctctgttcttatctctccttcttgctcccaaaattactatttttttatataaaatattaatattttttatgaaagataattttgtctaagtcaagtcagaatctttttaatgttattacaatcttataactcgaatttaaattttttagttaaaatagaacaatctcattctaagggattcatgcattcaatagttcaaaattattaattaaatgtagtttttttgaataataataatttcaagataataataaatagaattcaaatttaatagtaaaaaataatatattattttatattttaaatattatgagggaaaaacatataaaaaaattcttctgtatacaaatatattcttctaaatatatatttactcaaatgttagttgttacatttccttatttttaatcaagaatatttatatcattttacttatatttatttttttttctacgtgattaaacaagaaaattatttaatattctttcttttcattttttttcttttaaaagaatcatcgtattttttcttcacttttctttgtctttcttttcctttcggcaatttcccccgcaatttgttatagtgggaaaaaataataaaataaaataaaacgaactaggcagttgaattaaacaagtggactctttccaatgtagagttggaggctgcattatcttctttgatacccttttcaatcttccaccatgcgtttgaagtgacatttactcatttgtcccccctttttataatgactattctcaatccaaatacaattttaaaagttagcttcattgtcttcttttctcccggtacgagaaaaaataaataaagaaaaaaacacataaattgatgtatttttttttgtttaatgtaaagaataaaatgaaaaaaaaatactgtacaattttaaaactaaaattcaaaaatttcttttctctcattttaaccttaaattcaattttcagaattctctcactcgcttgttttgttttttatgtataatccaacaaagggtttcattgcgtgtctgataaaaaataaaaatccaggaactttttatccttttagttttcacccgaaaaatcacatttgcactgtaaaaagtaacaataacttattctaaatttttaattgttgtactgtcatttttgcacattattcatataaattctttaatcacacatgtctacgtttccaaccaacggtggtttgcaatatgctacaagatagagggtcattttatgtttattcttaaaatattatccattcttcacatttcaagcaaatattttggtgagaggtaaccggcaaaagataaaatgtcaatttgtaatatatcatcattgcttggcatattaattaaaagaacttttttaattttcacttttaaacataaacctttgagcctataaattatttaatcttggtttaaagccaggtttgtctggtttgccaaaaatggaaattgtaacttgtgagcacctgaccttgctatcatatgctaaaaacaattgttccagagcagaaaatgatagatggaaagttttaaaattattctttttatatataatgcccacgatccaagtgtattaatatttaataatgatatgatatgtcacttcttacacacacttcatacaaacaaaatcctcaccatttcttttttcattttgttttccttttacaccatatatctcacattttttaggaggggaaggataaggttatatcactttatttgtgtaagtaacttttttggattaataattgattattattattaaataagacaacccgaatataactttttcatttttgagggagcatgaaagttggagtacggaaatggattataacgggtcatttgaaacgtttagctttaacaacaaaaataaaaaggtttaacaaatggatgtgctcccgtgatagtaagttgaattgacacttaacaaaagaagaagaaaaagaagttcattagagttaaggaaacaaaaataataatcagcatcagagaaaacagataaccgccagacccacatcctatttagtttttcttctttgataaatgaaaaggggtgactcatcttatttagtactttacacgcctcatagatgtttttgatgtggttaaatttggcaagccacttattttgtttccatatttttcaccataaatttcccactcatgtgttagaaatgaactagaaaatggaaagaaataacaaactgaaaaaactaaaacatgttatgatagagagcacaaaacaatgcacacaacaacttcttgatttaatgatttttggctccactcatgctatactgtcaaactagtttcatttcaaaagtactaattttgatcccatcagtttccttcttgtggccatacctctttagtttacctctctctgccaaaaggataatttttaatatatataacttttttttttatcgaaatagaatattttctttccctcaatcaatcaaaatatcccgtctttattcatgaactatcatgtctgacttgaaaactaccaacacatcgcacccattgtccgaatgaatcaattatttggacctacttttgcactcccagtttgaatgaatgatatatataataaaaattcaatatcaatacttcccagaaaaaccaaaaattgcaaatgaattttttgtaaaaaagcaaatagaaaatgaagttagaagacagcactggcccatgcaggtcccaaacctgctgctaccttcttgttactggcacgatgatcaatccagctgagctaataggtgatgacacgtaattgctcacaaaatagaccactgggaaagagatattaatgctgtttatatatatacacacaattttattttttaaaacaaaataacacttttcaaaataaatttttaattgctaaaattctaatggagggaatagaaatataggcacacaaaggaccacatatttatgagagcaaaggatagaggatagagtatagagagcaacataggaagtgaagtgtaggtaagtgagagccatgaagggttatgagccccgttcaagctcttcatgtgcagcttgcaagctattgaagagaagatgcataccaaattgtatttttgcaccttactttaggtctgatgagtgcaagaagtttgcaaaggtgcacaaggtgtttggagccagcaatgtgagcaagattctgattgaagtgccagaagagcagagagaggacacggtgaattctctggcttatgaggctgaggcaaggctgagagacccggtttatggatgcattggtgccatagctctgttgcaaaggaagatggtggagcttcaacatgatctggcaattgcaaaggatcgtcttgcgcgttgtcacgctgctgctgctgctgctactactactatcccttctcctgatatcttgcatgccaatgttagccttcccccattccctgacttttgcacttcttcaagtgatttcaatgatatcttttgccacagttcttcgtctcaattattaggccgacatgaaacggtggatgatttcaatcaaatcccatatatattttgaatgttatgaattatgatgtatgcatgtttatggtccccttttgaatgtaattgttatcaatcaagagcagctacaatatgtcatatgagctaatgaataataagaactccaggagaatcaataggtctgaattgaaaactctctctcaacatgaatgtattattgttttgtgttgttgttgattgttgaatttcacggttcctacgctgctatagcagctaggaactggtggaaaatgatgggtatcttggcctttttttagtttcacttttgtaatagcaaacttagcaataggattatttcggttgttgctgctttctcttgcctgcctgcctataactttgcaaagtgaccataaattttagctccgaagttcatgctctgatgatcaatgatcaatctcttttctatgaattccggttatctcagacaacttttgtttggtttggttatagtaaagacacgattatccaggctttgagaggcatagaaataatttttttatataaaaaaaaaagtctctttaagtgtgaattcgttaaaaaagtctagttcaattgattgaataggatatctgaattattgtatataaatccctgacactgtcttctattcctaccgataaaaataaagtgtgaattcagatcaccttgatctagtcttgaacggtttggtgatagagaccagagcagccatagcattgattgccattacctacaggaacgagagagacacaaaccattcaagcagcacaaattaagaaagcaacactagcaattgattcttgcttatctttgaacgattgttgcacagtactgtgggtccaaccgtactgttttaatgcaacatggagcacccattatgattttcccttcaggtaaccaaccccacaagtggcccttgagctttatcataatgggaatccaaagagtaacgccaagaccgaaagtttttagcttctttgggggatgtacatttctgatagaaacaggatatgaccctaaagaaaatacttaccattcaaactacatgaattatctgttacacttacaccccccatgagttgcaccatatacttccaaacgcaccgcaagccaattttgcattggcctcattaattgatatcacatcacttatatgtttggttgacaatttctgagtacatatctgataatgccccaatacatgaacacacaccatgctcctaacatcaactctcggtcttgcaaagagcataacatgtgcccttgttgtttttcatgtgaattctcaaaaacttgtttcttgtgaatatacaatcaaggaatctaagccacacattctttaacatttattattattattattaagtgaaatttatgtttaagtgttactaaatgatgtgactgtaaatgttccactctatttagtaggtctcacagtttcacctaatgataaagagtgccaacattactgcaagaacagaagaacgatatggatatcttgtacatgcacaatagtttcaagatctacgaatttgaaacaaatctatctatatgatcaaactgtctgggaagatgaatcatttgagagtcagatccaaatatgtccttcacaattagtaaaccacatcgtgcttctgccactggtaaagttcatccatcagatctcagattatgactttttttccctatttcaacaaaagcacatgagaaagaaattgaacagtagataaacttttagcaatttattataagaggaatattgatgatagatctgaatcattatgcagaacaattgaaactggaacatatgttacacaaactcgtggttgaactcaaagcttgccatataaaccattggttcgtacatgattataaatgttgagggacaaggtacacgagtcaatgccaatgtgaggcatcattaacttgagctctgatatgacataatatgataataaggtctagtccaaagtggagaacacagtcaaaaaattgataaaagagaacgttcaacagaaaagatgaaactctcaaacagtgatttttttccccttcgtttgaaggaacaccaaatcccaaaaagaaaaagaataaaggcagcaaatcatgcaggaccctgacatcatggataccaccattatatactggcttgctcagcaaaaaacatataactaatgtactgcgccgttatattgtacatgggtctgtagtaaaaatagtgttgacatgacattgtacagtaaatataatgctgcatcaatatgcagtagcattccaaaggtaaccaacctaagatttccacattgccaccaaatattaaatacagaatatatgatacggggctctgccatatgcatattctatctcaggtatcatgtcattactaaacaaagcaggtaaacgcataaaaaagtaggagcatgatcaccaaccttccccctttctctttggcacgaaaaactataacatgtttggttgaaattgtttttttgagaaataattgcttattttgcaagggaaaaaaataatcaaataggctaatggtatgtttgaaagagaagaaagaaaataaaatataaataacaatttaaataaagaaaaagtaaaaagagaaaaaagttgacccttataatcaaaatcaaaattttttctttccttttctatattattctattcaatttagtaatatttgtctcttctctcactttcttccatccaaccatacataataatcaaaacccctttgttgttcaaaaactctctcaataagcttttaatgataaattgttttaaaaaaacaaaaattaaaaagctaacctaattaaacacgcactacaactatattcaccttaccaagacaacttcctctgaaatcaaatttcatgaagaaatcaactgagtagctgagtaaactcagatttgattgacatgagtataaagccaaacaagtactacatcataaaagaacctaacaagtcaataccaagattaacgtggcaaattccatcacttctaaaattcatacacaaaataaaactgtgcaattcgaatactcaatgcaattaattggccataaaaaaaatagcaaatctcttctcaagagcttgaaggtaactctacaaattgcaagtgcacagcatttgagtatgcttagaagaataaaagcccttccacaaactagagcgtatgaagtgaaatatcgtcaaacttttcatatctgccaatgctctcaattattttaaatttcattcaagaagaagaagaagaaatacttcacatttactggaagtgtttcggcagaaacgactctacagtcgatgtcgtttatgctgtggcgcgtaaaagaaacacgcgccaagaaagtggccgtttttgtggctatgcgataagggtaacattgtaattgtggcattggtttttgtctaatatttctggacagattagggtattgcattgggcacccaacaaattgccggtatagtccatacaagatggacaattccaatattatcggattcccattacgaattgacaatccgtaattcataatggctcattagcatgacgttaggtcaattatattataaaataattaatgtcaatatatataacattaaaaattttaatgtatatttaatgcacatgtaaatttacataacaaattttgtaaaaattaattttgatctattaattaatttgtttacatatataaatttttatgaaacctatgatttttatttaaactttatatatgtaaacaaattaattattagatctaaattaatagtcacaaaatttattatgtaaatttttatatatatatatatatatatatatatatatatatattaaatatacattagaaattttagttttatatataatgacattaattattttataatataattgatttattagcttaattggttagagcgttgtgttaataacgtaaaaatcacatatggatgatgacaatccatatcaactttacaaaaggacaatattggaattgtgtatcttatactggttgcgcaaaacaatacccgacagattaagaaggaaaagcccgaatgatgtgagtgtgtcatccatcacacagttaaccgggtgtactgggcttgggctctttttggaaactaaaatgggaatacacattttgtttgaacccaaataaagaagtcatttggattctcatagtaactatatgaactcaggttgttattaggtgagttgaatttcgagagtttatttgaattaaatcaacataggttttaaagactcaaaaagtgcttacaagatactttagtatctaattctttttaaaataactggaaacagttatatatatgaattcacttttcatgttttttagtgtaaatttttttaattattaattaattacaaaacatcttaaacaataccaaagctaacttaatttttgtaaagaggacaaatgtaaagagtaaataaaatatattttcaaaattgatatattaaatttaaccaataataaaacggttcacattgcctttcacttatacaaaatgtaaagtttaaaaggaaagaaaaagttacgaacgatagtcgttagaaaaatttgagttcaacatgcctcaaggagtcacctttaattattaatattgactttgtactaaagagattagtaatatccttttcaatgttaaaaactaagctatttgcaagaaattaatcgttcatttcatttgtaggtttgtcatgacaatttttattgctgtaaaggctctctttttagttgttgtaaatactagaagtttcaaaacaagataattcaatctatcaatgaagtcatacttttttaactttcttgattctactaatttgtggtacaaaaattagagagtgatgttatatcttggaaagttggatggtaaggtatattaaatgtgtaatatctcaattgtaatatcaaatgaaatgagatgagatagaatgatacatgatcatgccgtgtggattgatgtgagaaaattacaaatatattattgaagtgaaattctaattttaataagataatatacctgtgatattgcatttaagttttgcccaataaaatacatcaatcttattacttccactgtttccaaactatagttgtataaggggtatgcaagaaattattaattgatatacttttagacttaattctaactttcaattatattgttggaatcatcagtagtcatcaatatttgaattgtggagagtcacgaactatgttagtagatattttcattgattggtggttaactattggcttagatattggtgtccaatttggataataatgaaaattcaatattacattaactactttttttaagactatcattattcgatatttaatagaagcagtgtacaagaagagtaaataagttattagagtgataaaaggtatattatgaaattacttgatgttttgttttaaaattcaaaaaattaattgcattctttaatattagtgttaaaatcttaaacttcttataatctagaacaagaaaagtataaataaggtataattagaaaaaagttatgagtgcaatattggatttgtaaaatatttatagttattttttttaggaaagagttgttagaaaattcaaagaaaataaacaccgatttattcaatagacatgaataatcacataagtgagtctcacacatgaacttacttatatgatttcttataatttattgataaaaatttattcgatatttatctcttacatatgcacaacatgtgtctataaattttcacctatcaccattatcctccaataattataaataatgttttatgacaaataaagatactgcatataaaaaaaagtttccaaatactagatactgcatataaaaaaatttcatttacgttttggggacactagatactgcatataaaaaaaaaaatactttttacattgaatcctaaattagttatacgtacgtgatagtgaagaaacaaaagtttccaaaactatagtgagttcagatattttgattcactacaccaaaattgctactatagagcgcctattacatatcgtttaatgaaaacgcgctatatatatagaaccgcataagggcttctctctgtagaagaatatcgttaagaaaaagaaatcctggcaaaattgtgtaaaaatgatttaaaaatataaataaacataatttataacataaaaaaagatgaaaattcttcaacgtgataaatagatatctcacaataaaactattatatatataaatgttctaagacgtaccatggcatcactaaatgtgatttgttaagagaaaaaatagcaccttaaaaaaatatcatcctttttcgatatatcccacgttttgttttcacccactgcgttataattaaaaagtattaggtgccacaatggtttaattttcaatgatttctgccatgtgtgggaatacatggttttgtgtttgaatctcagtaaagagaacgaaatcggctacagttgaattaaatgagtaatatagtttttcaaaatatctctgaacgacccatgaacctgattcatttgcaggtcatgtgctgttgctttatacattgttcagagaatggtgagtaacccaagataaatgattctttgagagcaaggaaattacttaactgtaacctacgataacctacgatagcattttcttagagaaactttaagtttattttaagaaaaacaacgaacaattataactaatagattttgagattgttaaaatttgtttccgtaattgctaaaaaatgattcgagaagtttgagtatggtcacacggaaggtcaagcctaattggttctcttgttagatcactctctaaataaaagaaaaaggtgataagtgatattatgactcatgagagaaggaaccgtgccagaaccggtagtggatattgtgggccttaccatgttttggtataatttttgtttttggttcactggtttagttgtttttcgagtcactgccatatgtgccactaatagcaacgtctctcccaaatcagttgcatgacccctttttattttctgtgtcgttatcatttttttgggcgataggtaagttagcctaaatttcattgaacttaggcttccaatgggcccttatccgtgttgtaaagttacactcagtcatagccaagcctaccttgacattctcataaaaactaaccaaaagaagaagaaaaagaaatagtccttgaaatttttcttttcttattgaccaaaaagaaaacaacgaaaataataataataattattattattaggaaataaaagaggaaaatcatacttaccttgtcctcgtccaactcaagcgtgaagcttcacgccacacccatgccaccaaaaaaccagacccacaccttaatcacgctttgatatttgtttcatatgtttgcatccacgcattagtactttgaaaatgattctgatttatataaccagacagaaacacaagacaataaattaatatgtcgttttgcagtggttattattcgtatgcaggttcagtataagtctccttttttgtttctttcccatgaaaggctaacaacaaaatggtcaggggatcgggtaaacagagagtgatcgagaaaatatagaaagcggtacaaaagattggaacaaaaaactatatatacaaaaacaattgtaatgcttaacaatcttttttttctattagtgcagaggataatgtgagttttaagcttggagaaaatatgtttaacattgtttattttattcattttttataggaacattttaggcttcttttttggttatagaaaaattagggtgaggtgatggcactacagtgtaaggtaggaaaagttttggggttcaaataacactctaaaagaattattaaaagagatgaagttaagaagatcaaataaaaaagagtaattcgatatgcttgagattatatatatatatataacatcagtgtttaaaatgtgcatccaaaaaataaataaataatgtcttattgagatagaaaagaacaaaaatttgactttagatggtatattttaatttataacataagagtaaatatatttttattaatttatcatacttatatttttcataaattcaaatatttaaattattattttaaatgtttttaattagctaattgatattttcagtccgggagattagttgcagtaaaaaagtccgggtgattagagttaaagaatatatgtaaagatatcttaataaaaacaaaacaaaaaacaaaaaagttagatcaggcaatcagattcagatcttcaaagtaatgatttttttaatctgacactttaacttcttatccaacaataactatgtctatttatacagactcctgcaacttaaacacgttactcagttggaacaaaaaacaaaacacaattacacaaattgtgtgtttgaatcaacattcatcaaattgatttaaagtgatataatttataatattttattataaaattaattaagttagagtaaaatttaatataaaattttagatctaatataaaagttactcaaagttattttaatccaaaatcaattctaaattattttttaccaaaaattaaacatataaaaagtatccaaataaatttggattcaatcattttcctaacaccaaaataaacatacacttaatgttcaacataatattttacactacatgtcataatcaagaagttattttttaaaattcaaatcacaaaaccatgataatgttggcgaaaaatgcagcgaaaacgaaaaacagagtttcaggagttagttcaaaagttagttctgatgaacagtgcctcagaggttgtgaagagcacagaagttctgaagcaacttctgaggttctgaactcaaaaaatctaaaaatgaaaacgagagaaagatggtggttgcaatctatttcattgagattattgaaaacaatgattacaacaagtatttatagcctaaagttaagtaactaactttcctaactttaggccaagtaactaacaaactagttactctaacaaacttgtcctaactatacggttaagactaacacatgagtaattatggattaatctcaacacacctccctaatccataatctctacaccagtcagacccagcttccttctgagttcttcaaatctgtccagcttcagagcttttgtaaaaccatctgcaagctgatcctgagtagggcaatacaccaattcaatcctcccactcatcacctgttctcttatgaaatgaaaccttgttatgttttgaccttccatgtgacactggattcttggctagattgattgcagatctgttatcaattaacaacttttgaggcttctgcaacttacacttcaactccaagcataatgattctaaccataccagctgacaagctgcataagttcctgcaatgtactcagcctcacatgatgataatgttgtcactggttgcttctttgatgaccaacatatggctacaccattaagcatgaacacatatccagatgtgcttcttctgtctactctgtcaccacaccaatcagagtctgagtaaccaataagatccagctgatcctcacctctgtttgcaggaaataccaaaccatagtttgcagtgcccttcacatatctcaaaatcctcttggcagctatcagatgtgattttctaggctcattcataaatctactgatgacacctactgcatagcaaatgtcaggtctgctattgcataagtatctgagtgaacctaccagttgtttgtacatggttgcatcagctttctcctcttcactacattcttccagttttgaactagtttcacaaggatttgagattgacttacactcaatcaacccaaatctgtccagtatctcaagcacatacttctgttgatgcatgatcatccctttctttgtcttcacaaactccagacccaagaagtatgacaattcacctagatcagtcatctcaaattcttggtttagggtaagcttgaattcctttatttcttcaggatcacttcctgttatcagcaaatcatctacatacaaacagatgatcaacattcctgaatcctttgaattcatcacatatacaccatattcaactgtacacttcttaaaccccaattgaattaggaattcatcaatcctcttattccaggctctgggtgcctgcttcaaaccatataaggccttatgcaacctgtacaccataccctcctttccagctatctcaaaccctggtggttgagttacaaacactgtttcttctaaaggaccatttaggaatgcagatttcacatctaaatggtataaaggccaattcctcaagtttgctagtgccactactagcctcactgtctcatgtctggctacaggtgcaaatacttcgttataatcaattccttgcttctgaagaaaccctcttgcaaccagccttgccttgtgctttgacacacttccatctggattcaatttggttttgaacacccacttcagatcaattgttttcttattctctggtagttttactagctcccaggtctgattcttctcaattgaactgagttcttccatcattgccttcttccagactttgttcttcaaagcatctctgtactcaacaggctcagcatctgctaacaatgcaaaatgaatgagatcaccctcatcactcactgcattgtccagtgctctttcacaatcatccagcctcctaggagcttgtctaatcctctgaggcctcacagaagcttcatcctcctgtggtacattaccatccacttcattatcaccttcatcttctgattcatcactcgaatcagggtatatgaagccttgttgaatctcactgctgtacactggtgtcacctgccatttccagctttcagattcactcactatcacatctctgctaatatgcaccctctgagttgtaggatcatatagcttataagcaccagttgggtggtaacctataagtatcatgatctcactcttatcctctagcttacttcttctgacatctggcacatgcttgtaacacaatgagccaaaaactctcagatgttgtacactaggcttccttccacaccaagcttcctctggaaccttctccagcttctttgtgggacacttattgaggatgtatgcagctgtggtaattgcttcaccccaaaactgatgtggcaatttcttctgcttgatcatgcttctggccatgccaagtaaagttctgtttcttctctcagcaagcccattatgctgtggtgtatatggggttgtcacctcatgcacaataccatgacttgtgcagaatgcttcaaaatcttttgaagtatattcacctccaccatctgttcttaagatttttattgacttatcactctccttctcaattaaaaccttaaacctcttgaacacatccaaagcttcactcttcagctttagagtatacaaccacaacatccgagtaaactcatctataaaagtgataaagtacttgctgccacctaaggagggcacttcaaagggaccacaggtgtcagagtgtaccacttgtaatgcagcactggctctcttaggtgcttcagtcacaaatggtagcctactctgcttgctcttcacacaaatttcacagatttcccttctagcgttcaacttaggcaggccataaactaaatctttagaattcaattcactcagacttctaaagtttagatgaccatacctcatatgccacaaagcctcagtttcttcacttgtaactccagacatgcacatcatcttatcactagagatgctgcacttgtaggtcctgttctttgacagattagacttcagtaccagattcttctctgcatcaaacagtttcagtgaatcaccatccatggttactgaaaaacccttctccaccagttgacctatgctcatcaagttgcaattcatttctggaacatacaagactttttcaattattaccctcttcccatcattccctctgatgacaatatttccaattccttcagctgcaagctttctattgtcagcaagcttgatactagttttcttgctattatcaaagcttgttaaccattctctatgtgcagtcatatgattggaacatccagaatcaagataccattcttcattctgcaccttatcttcacaagttgtagccatcatcaacacagtatgaggatctttaccctgagccacattagcttcttcattattctgccgatccttcttgaaccaacactcatcagcaaaatgtccatacttctcacagttgtagcactgcactttactcttatcaaactccttcttcttgttatgacctctgtcagagcctcctcttttagaagattcagctttgtcatcagtcttggccttcccattattagaccaatttcctttgccttttcccttcttcttggagttctttgaatttccttccttctttgaaatttgtgcttgcagtgcttgttgtactgatctctcagtacctctatcaattaccatgagctcatgtgcttctaatgaattctgcagctcctcaatcttcatggctttcacatcttttgcttcttgaatagctacaactatgaaatcaaatttagaggtcaaggatcttaataccttttccaccaccatttgatcagtaatgacttcaccacaagtctgcatctggttcactaaagatgtcagttttgagaaataatccccaattttctgaccttcctccatctgcatcatctcatacttccttctgaatgactgaagcttcacttgcttcaccttttcaccaccatcatgatatttttcaagaatatcccacgcttctttggatcttgtggcctttgcaatcttctcaaaatgataagaatctacattctgctgaatgtaaaacagagccttacaatctttcttctttgcttctttgaacaccagtctttgtgcttcagtaggattcgcacccaaatcctcatagccattctgcacaagatcactcacttcttgcgcaccaaagagagacttcatcaaagcactccacctatcccagttctttccatcaagaaccaagatattggatgaaaaaccaccgttgttattcattttactcgccaaagatcaaatcacacctcactcagtgtttcccaatgtgttttcccttcacaaattcactcgtgtttccctagatttcaacccaccgctctagataccaattgttggcgaaaaatgcagcgaaaacgaaaaacagagtttcaggagttagttcagaagttagttctgatgaacagtgcctcagagattgtgaagagcacagaagttctgaagcaacttctgaggttctgaactcaaaaaatctaaaaatgaaaacgagagaaagatggtggttgcaatctatttcattgagattattgaaaacaatgattacaacaagtatttatagcctaaagttaagtaactaactttcctaactttaggccaagtaactaacaaactagttactctaacaaacttgtcctaactatacggttaagactaacacatgagtaattatggattaatctcaacagataatacattgaaaaataaaaatcctgctggatacttctccactagacaaatatgtacgactgaatatttaatgtgattattctaatttaattagtgatatcaaattttaaataataaaaatataattttattaaatacttaaaagaagaatttgttttctaaagtgatttcatgagaggatacttatattattaaaaaaatactagtgaaatatttttttagaggtcaatattagttattaattaggaggtgtttatttcaagttatcgagaaaattttctaggaatatagactttggactatcacattctcatgtttcaaagttttgtaaaaaaaatcaaaaatacttggatcctccgaaatcataattacctgaccttaaggttcattccctctttccaagattgtattatgtaagaatcaaactcatatttttcctataaactcaatgtatgttatcaattgagttatatccattaattcacatttattgttttactttttattttaatttttttaattaaataaaatttgtttttttctaaaattcctaatgacaacctacatgttcatgaaaataatattctcaagcatagtattcctaggaatataattttcaaaaatacaattttataacttaaaccaaacatcttgataatttcttagtggaagggattcaaactcattacttccctcccttaaacccttatatctctatgctaagtcaaatatataaaaaatgtaaataaccaaaacactaaaatttattatgtgtttacaaacacgttcatatttgattttttcttttatactaagcaaattcaatatattttctcttttatgttttatgaattgaaacatgtccaaaaattgttatattgtcgagaatcatcactatatcaatcaaggaggtctaatttaaagtgtgtaagttattttaaacttttgacttcgtcttaaatttatatggataaaaaaaattatgatcttaataatcaataatcacgtgacatatgaattataaagatgatttgctaaaattaatgtgatttgcacgatttcggttaaatggaataactttattttttcaatttcagattttcttttatccattattacttattagtgatcaatcaatttctaaaaataatcgctgattgtttacacaaaagttccacaacgccggaaacatatcgccttctgccattgctgtgatgttaatgaaaatatagtcaaatcatggtttcacatatattagtcaaatcgtttactaacatgaaacacacagcaaaacttctgccattgttaatcttgtgctagtctcatttcaaatcatggttgaaagttaagatcttgtataatagtaaaatcgtttatgggcatgaagcacaccacaaatctgttctaccatggacatggttaatcttgtgctaatcttctgctatagctgcaatggttgatgagaatatagtcaaattattgctgataagataaatcatattcttttttggtattatataaaccatattcttgaatagaagaccctgaactcaagtcatgcagcaatggcagagggtgttctttctggccttgtgaccagattttcgtaaatgatcagcgattatttttggaaattaattgtttatgatttgattaaatgtaatttgcattatttgccgttaaattgtttaacttattttttaaaatttcaaatttttctttgtcctttgttagtgagtatctttgctgatctacatgtcgcataatttctggttgggaccacaactgatttgatgttccttaatcaagtaataatttcttgttcaataggtactttggttgataaataaagtaataaacacacttaattattgaaaatcaggctcttaattgacaaattgataaagaataaaaatacactattgttccaattaacgctgaactcttgggatgaagtgggtcctataactcaacaatatatgatccaaaataaattgtatattttttttgtcagtataaataagtcttcataattttatttataaaaaatgaatgtcattaaactagccaattattattaatgtattataataagtgtcaatcgacgataatcttaaccacatgttccacattttatctcatactcttggtctaatacttctgttaagtatactaaaaaaaggtttaagtggttgcgagctcaactcatagtaattgagattcaaattaaatacttaacctagaatcttaaagggttgactattccaagttcccattccatattctattagaatttttatagtttggttattttctcataacctcatattttttaagagtgaaactataaattttctttataataaaaatacctgttctatattgaaatgatatttgctaattaaattttagttgcaatgagaataccgaaaggtcattgagtattgaaccctctaaattagattgtactccaatccttacaacataatctctacgcatcataatctctacgcatttagtgcttgagcttaagaggttgtgcaaccttcatatcgaatcgaattgtattttaatgtcctccatcaagacgatccttggcccaattcaattaatgtcaagtgatttacaacaaatcacaattaactagagacgcacaattacctcctataattcttagatatggtgtaacattttggtacacattaattgttagaattttagaggatctttataaaataccaataaccatatgaaacacattacgttaaattatcaataaaatgtataatgcgccaattgaagagacaattttacggaatgtcttaatagcaatcagatatatgggaagtctaaaaataaataacatccatttatacatctaaataattttatgatataaatgtctaaagttaatatgaaatccaagtgaaagattgttaaaaattttataatttctaattaattaattaatgtgacttacatattatattataacatatagtttacattaattaattaagaattacaaaattcataacattaatgtctcaatccatggacgttggaggtaatacgcataacaaatcatgataaataactcacattctggcctagaaagggttcacttgagtactttgaatttgatcatctttaccatgagaaagtctttccagaaacaaatatgaaaattgttcttatcactaggtagtatcttagagaaaaaaagacttagttgataagtattcaagtgtgtaaaagtatattgtgattcgtcttttttatatttaatgagttatataacaatattatatttggatcaaatagtttgacattttagttaatgagccttggatagatagatctaataaaaaccaaaggatacaaaagtcaatggtgaagagatggttttccatccgaagaggcgatcgaaatcccttctggtatacactggacacatacattatcgcatccaatacacccatgatgtctctaaggaaaaaggacgtgtcggcgaacccgctacactgctccatattcaactatatgtaagataacgttgatgtctactgctcccaatccaacactttactcttcttcctttttttcttttctcctcttctttttattctttgaaaactactaaattcaaagcaaatcttaattagaaagcaaaaaagaaagacataggttaatgatatttttgctctctcaattttcacactaaactttttagttccataatcaatatctaaaaacacgattaagaagaagaaaaataaataaatagcaagcaaacaaacaattattatccacgcgcccagattgcgtgtacacctaatcacctaacttaactataaataacgttagccactcgtgtcatttctcacttcacaaattgccagtgcctactaatagcaattgcaaccaaacagtgtctcatgatactgtttgttctgatgccccaccgtcgaagccctcctccgccactcgccgccatcgtagctctcccttctcacaccgtggaatcaaatcacgatgtcgagcccagattctcgatcattcagttggcactacacggaactcgatgacagagacctcgagatccgaggtaggactctgttttttgtcatcgtactcttctccattattctcctcgtcactgttctcttcatctacacgcgctgggtttgccgctaccagggacgcctccccaccaccgcgttcaccgccgcagccgcccacgcgccgccgctcgcgcagcctcagggaatggacccagcttccatcaagaaattgcccataatcctccaccacgcgccgtcggaccgcgaggaaagcgcgtgggacgaaacggagtgctgcatctgcctcggcgagttcagagacggcgagaaagtgaaggttttgccggcgtgtgaccactatttccactgtgattgtgttgacaagtggctcactcatcactctagttgccctctttgcagagcttctctcaaggttgaatcttccttccctaagattttgattcaggaaccaccccttagaattgacttccagttctaggtttttttctttttttctttttttaagagagaaaattttattcgaatcgaataagatttttatcggcaaaaaaactcttgtgtttaatgcaaatgtatatgcagaattggaatttgaaaccaatgattaatctgaaacaaagtttgtttctttttattttggtcttaatcttacattccaatattgttgaaaaatcatacccgtcagcaagtttctcgatcgactcatcatgacttcaagtctctgggtgttcatacactagatggtaaatacatgtaaaaggaactcgtgtcagatgtctgctcatggatatatagaattttgaatttttttattggactgttacagtgtttgggttgttgtggagaatatttttagacagtagcacatggcaaaggagggagagaatgtggagtatgtccgtgatagtgttaaattatgatatgttcccacgttggatgatagacgacctggggttcggaaaggtcatataattttcctcaacgccacttgttggataaaagtcctcaaagacgttgctcttctgagtcatccctgtgtttggtctactaattggatatgtggtcctgcttcttaggttctataattggatttaatcaagattttttttattagagattgagaccccaaaaagataatgggtgctcttaagttacggagctgcttgctcgttgccttaggtactgcccaatcagcttctttaatatattttgctataaaatatgaatatggaaggaattccatattacgattaaagtgtatagtttttttttttgaaattctgtgcatatatgttttttttttttggaaaaaaaataaattatattaaacccaaaatgataacaataaatggaacatatcccgcaactagagaaaattaaaaacctccctaatataagaaggtctatatcaaaatgttaaaacaaatacaacatgtatgcttgtatatacataagaaacttaatcttgctaataatctctattacagaaaattggtaatcttcaaaaatcaatttgttcctagacaggcatatgcagtaggctgtttgttatagtcagacaacgaaatttttcctaaatatttgatgtaaatctgtctttaattaaagagttggtaatacacttaaacgtccgcccaacgaagccaaattcaacacaatgtgagcctaatttttaatcggttgagtgagcaatgtggactaccaaaattaaatctttatcagtccttatcggctaagtttgaagttggtttcttgtacgtattttctgttggaaagcaatcgaacctagctatatggacaataatgtcctgctagaaaattaatctgccaacttacatgttgttccttggatatacaagcagcattcatcgcggaaaacttgcccgatagcgatcaaggatacggatacctactgtacatctaaacctttctttttatatgttaaaaaacaatatcgatatataaactctttattatcgttattgttcttataataatttaaagatcaaattaataattaagttattttttttaaggaagtgttaattaggattggtgagcgtcctcttttattcctttctagataaacggaacctcacatgcaaagtgaatgattgactagtgacatcactatgtgtttgatagaaaggagaaaaataatctaatagaaattttgtactttttttaaaaaaattacatcttttatattttattttaataaaaaaatcttttatttttatctttattatttttattctctaaatcaaacaaaccctgtaagttatgggctcgtgcatatgtgatagttccgtgaagcaactcgattgttcacctgatcagcttggtatattttctttatattgcacatagcttcctgttttttaacgattacactgtatagtatttttcaaataattaagaaatgtcagtctaatattttttaatataattttaaattttttataaagataggaaaagagaaaagtattaaaagaaatctgacaaaatcttaaaagacatatttgacttgggctgtgtagtgtgtacattgactgtaaacctctgagtagggcatcatccaattgaatcaataaaaaaagcaaatgctttaattacgctgaaaaagtatccttttctttttttttgaaattattcaatgaattaaatatcacagtgaaatttaaattaaattaaattgataacatatgtatttattttctaatttaaaaaaaactgtcaaaaaaaattcttttttatataaggatgatgttaatttaatttatttttgagttgttaatcttaacaatacgagtagctataatagacagcgatatcgagttgttaatacgagtagcaagcaataccacaagaaaaaatatatcaacacgggtttaatgtttgttggctgacggtaattaatattattagcattcgtgttgtggccaacatcgacatactgatgttaatctaatttgcaaaagtattgtagtgctcacattaataatttttgtaacaaaaaattataataattaacataatctaaacttcaaagagtatgaaacattttttttccttagaagtatcttttgacatgtatggatcacaattgtgtattcaattataagttaggtgtcctatgtttctttttcactttccacaaaaaggtacagttgacatgttactctaaatagccaagactattagcctttaatctatataaactaaaaaatagaaaaatagagaagtattatattatactttagttatcttaatattttagtaataatatcaaacataataaagttgtcatgtgaactataaaatcacagtagataatatacaataatataaataaaatagaataaaatgatgtcaatgaacaagtagaagaagaagttaacgtacatacaaccaatcacgattaacacacataataacgatttgtatccttcaattaaataatttaaaatttgaatcgatattaagtttgagatatacattaacaaaaaatattattagaattattatttacaattttataaattataaaaattagattacattaaaacaaatcatccttccacaaacaagttcttgcactgaaaaatttataatatttctccctctcgaaaactaaattacattaaaacatacaagttataacccatgccatgaattgggcctcataaaaacacaatgggccgggccatcctgatgtgttttgaagttgaaatgttggaaacccatggggccacgggtttacgattgaagcccaattagctagggttttggttcgctataaattcctgaaacgtagctcgaccctgctcccaacctccgttatcaaaacgcagccaagtctctgttctgtattctagggtttggattctgagtttcgtttcagtttttgatcaccatgagagctaaggtatggtcctttttgtctctttttgttctattgttattgtgtagttatttggattttgttctgattgagcccgtggatttgtacagtggaagaagaagcgtatgaggaggttgaagaggaagcgccgaaagatgaggcagagatcgaagtagtgtgcttgtttccccagcaactattgctactagttttgttttatttcagctatgtttttgtttccaaatgttacgatacatttttattggtttctcttgcttttgtcttacctcaaaaaagatgctcttaccgcaaattaattagatttaatatttgaatctattgttctctcgtgcttgttttggtttaaccattctggaatttcgatatttcgcactttcgcgcattacactgtacataaggtgccatttttttgaagaattaattaactgcaattgtttggtccctgttcttgactatgttaaagtccaggttgaataaaacaactgtttcgtcattgaattgtgaatccttgaagataggaactgttaaaggagttaacgcgtctgggttaatgtctggaagttttatcctttcggatatcatatgaaaggaggttatggtgtctaattacaattgagaagaaaaaattcaaattgcgtgaatatcttctttgtgagataacgttgattctgcaccattgttattttcatgcattgatttgaatacatgttttagtttattgtgattgatgtgtttattactgcacattctggaatagtgctgctttgaaaacgggatgacattttagattatttaaaaatcacagtaactagtgtaaagcgtttttgaaaactcattgagaatgcagggaccaaacttgagatgttgaagctgtaactatagtttctgaaattcacatctatatgtggaaccaaacacgctgctagttcctatttgatatgaagttcatggtcccaagctggaaaatatctttagtgttttgtgttgagtggaatcctttttgtacttaggagttcagaaggttcgatgaagaggatgatctataaatatctccaatatatgacagtaaacttgtgcggtctcgttaataatagtgttgctgaagtgatcgcttgtaggtttcaggttgcattaaatttctgtcgttaatactgagagcatcttccaagggacagtgtattccttaaataagaaactgtttcttatgaataaaaaatcattatttttataaagtctgtgctccccaaccacaaaaataacaaaaaaggaagaagatgaacagttccaaactcgaaattaccttgacagtgagaagtccaagtgcgaaagcactccctttctcgacctcgtgctcaaacggcattggccttggcacacgccgaaatggcgcctccaacaatcaagcaaaggagggaaacaacgcaacatcaaagagaggaggaggggaagagatttattattaccgtttttggagagattgacaagggcgtgcgcggcgtgcttggtggcgggccgattgggttcgttccagaagaaagtggaatcgaggagggaaactgttccttaacgtcggagaggagggcgcttgttgtgatatgttgttgttagggaagcttttggagaaaagagtagagtaagatttcggaaaagcgctttttgaaggaagaaaacagtagtgggaaaggaagaaaagagaaactaccattgattgtgaaatttgacatttgtaccgttgaatgttactgttgtgtaggttttttttttctcacttgcactgttcattataaagtgtgcattgttgagcatgttttgcccaattcatttgtattgcaatccctctttattagtgaaaattctcaaaatccactgcaatgttatgtgtccactatcaccccctactagtgaaaattctcaaaatttatcacaatatattatgtatccaccacttggacacgtggtatatgcatccttcatccaatgtaaagctacctaagtcacctatcagtggtagttctcaaaatccacaaatttataatcaaccatcaactcccaccaactcaaacacatgttataggccttctttatccaatattgtgtcccttagcaatgaaattgaatcacccatcggtgtagacaatattcaactagacgaaggagatcaaaatttagatgggaaaaaaagccgtatcacattctcagttacagaagatgtgattcttgttcgatcgtggtttaatgtgtcaaaggatttaattataggagctaaccaaacatcaaagtaatattgggcaaggataaaaaaatgcgtacaacaatgacaatgtgcgtcaaagcgaacaattttgtgaaagaagctggactcaattaaaatctcgatggaacaggatctattctccagttcaaaagtttaacgggtgctacaaacaagcagataaacataggagaaatgaaagttcagagaaggatattttggatgatgctcatatgatttactcacaagacacaagtaaaaaatttgagattaagcatgtttggttgttgttaaaagatcaaccaaaattcgatacagaatttatgtcaaagtgtttaaaaataacaaaggtttctacttctagaaattactcatcgtcttctaacccaaagacacccgttgaagtcgaaaaatatgatacgccttcgccaatgtcttacccaattggacaaaaagtagcaaaaaagaagaacaaaggaaaagaatctatgcatgcatcatattgcataatatgattgttgaagatgaatatgacacatatcaaaataatcagatcaatatacctccaaaggagagcacaactttatgacaaacaacaacattgtcaatttcaagtagatttagttgaacatatttgaggacattttgaaaatatttaacaattaattttatgtaatattttttatttttcatcattatgttttttatttcaatgtcattatatttatttatctattattatgtaaaaattactttattttaatgttatgcaatttttttattttgaatttatatttaatattttcttcatttattcatatttattatttgtatacataaaaactaaaaaaataaattaattattcttataataaaataatttaaatgtttgaatttcttatcatttcttgtattaaaataaaattttgtatgaatttcttataagcaacatgacattatcagaaccacaacaaatattacgaaaaccacataaaaaatattaaaaaactcatataagaaacttatgttgaaactatttgatttaagtcatcacccatataaacttgtccaataacacttgatgtgtactaaatttttactaggtgttttaagtcttagtatggttaggttaggttaggcttgcaggacaaaacttctatttcatcatgtattgatttcatgatttctagacgattgatgttgatggaagcgaatcttttttcttggtttagccatcgtggtatcgccagttttgcagttgggtaacgccggttttattatttagcaaaatatagcgtctagctgcctctgaaattttttattttgatttttcaatttgttgcagttttaaagcacaacttttatattattttaatcaacgaggattaaaaggtaattaaatctcggaattatcgcttggtgcattcaagacttcaaatcgagttgaggattttttttaatctagtattttttttttgtcacaagaaatgtaaactagtgttccttaaaattactgccgtctctgaatgaggctctgtagtgaacattttcttttcttaataaaaatgtccaagtttttgtggggcaagtctttgatcttaattgttgcaacaaataagtgttgcagatatattttcataatcttgatgagtccaggcaatctagctagttgatgcaggccgaagtgaacatgacatatgagctctaagggccatctgttatttaggtgtatggtgacacattttgggcgagtaaatggatggagcaaaaagatgttttgtaactgcaaattcagtaggaatgctaacaatacatttcctaacttactgctatatattagttaaaatcataaaagaaatcttcaataaataagatgtaagacttgtaaaagttttataatttttaataaattttaactaataaaagatagagaaaaagaattatatattgatagtataaaataatttttcaaccattcaattataaattattagtttgataagtttgttgattttttaaaatgacactgaaaattatttgtttgattgttttatactttcaatgaataaacattaaattctacaaaatatgtttaaaaatatatgtgagaatttgttcctaatatttctcttgttccagtttgacatgtagatcagcagatggcacgtacgagagagataataaaatggaaagttacagctcggcgtgaagcatagttaccgtaaatcgttcataggattcgattcttgtactcgttaaatttacgttacctacaacacaatggaaatagagcaatatttgccttacatcgtcaatactattattgaacttgttaacacttgtccatgcttcatttggtggtaaaagcaatttctgtctctcccactcagttgtgtgtgtctattttcttacttttcggctgtttaacgtgggttgtctttgctactttgctattaagttactcattttatttaaaatcatttgacaaaatagaggaaaaattgtgtaaagagattctttttcaatcaacggggtatgaaagaaatcaagtgatagaatcaatattaataaaaatatatacatttaaacattttctagtaatttataggatagtggaagcaaaacttgcttgtggattaaaaaaatagctgcttttaaatgttgcaaataagggtgctcaaatataaaaaaattagaaagaaaaaattaaacatttccacattttttattcaaaaataatatatatatatatatatatatatatatatatcaagcatctcttttctctccgtttttccatctctagttatcagttagtagcacctaaatgtccatgatttttttttattccctcgtgttaacagtatattagttaattgaaaattgattagttaatcagattgttaagaatacttgttagtttaattacctttttaataagttctataaatagagctcaaactccccctcattttgtatcttttatcaatcattagtataatgagttatttttaaagtacttctcttctagtttttgagatctacgacctttagccaatgtaacttccatctcttatcaagattttgataaccaccccccaaaataatcatttttatggacgacttttctttaagttgcctttgttttagtagtaataatcagaacgtggaccataatgggttccattggctgctttattatgtcaacaatccaagcagttaagaatcttgtttacaagtagttaatattagatattttaaattattttaaaataactatttaatattttttatataacagaggattttttttttcagcatttgcctgattaattaatgaaggaaatatctggcgctatcatataggagatgaaaacaacttgagtggacgtgccaatatttgctgaatccattgatcccttctaattcttaaagtcaaacatgatgtgatttaacactaacatctgtctgctaagaattaacgatcaacgtaatgatcaattgcttttccactgttctttccctttctttttctcatcattttgattggatcataggtaaaaaattactttcccacttttctattttttaagcagcaaaaggccatacatacacttgatttcttaacattttactcatactttgctttgcttcctttcctttcaatttaactttgccttaattggttgcacaaaactaatatttcatgattttatcttcctaatggggaatctatatatatatatatatatattgaaaataaagcaaataattgccccatactgcaatgaatagtggggaaaaaaatattttttgcaataaataaattactgtaggcagtgagaaggcaagaagaatctctgcctcttacttctagcgggacaactagaagccatggatgatgaagcaattttggtgacagcagatttgagggactgtttgagagtggcaaggcaaacactgtcttctctatccttagaacaaagcaccaatatgcttttgattctgccaccaacactggctatgtcagctttaactgctgtgagtctcaagcctttgaggacttggatgagttcagggaacagttctggtcgatcatcgcagcaaacagaagctttgatcacaatattgtccttcagtttgttcactttagtgcagctttcgtcttgaacatggtcatagtcaattgatacttcatcaatttctgttggaactgtgaaggctctgctaacatccatggcttttcgctttagatctttcacttggtctatcacactccctagtaaagctgccttgtccatctgcaagtacacaacatcttaatattagcatgattttcatgatttcttacttttcaaccagtttccaaacatgctatatgttttcccactataaataagctttgtgctatattctctctttgagatgaggaagtggaattgaaatcctttgctaagcataccatgtcacatcactttcatattccattcattacacagtgtgatgataccaggaacaaaatccaagttattcattcccatattgtttatacttatagtactaccatactactttttttttatcagcaaatgttagtttgttagttttgttagaaatattagttggagtaattcgaatctgtgacctatctttcctccgttctcccttcatccttttccaaccattaagtcaaccttatatcttcctggataatactactatgtatgtatgtcactcatgaaaactgaaaaagagactcgtgcaataaaaattggtttaccttatcagacttgggaataagttttctaagagttgcaagctgtgcgttgatcctgtctctgcgccttttctctgcttggctgtgactcttggaagcacttattgctctttcttctgcagccccttcaatgggaagtggccatgaatgaaactcaccaaactgaagagaggcagagtcagtgacatgatgagggagtatttgtataggcactgcaaaggaagaagaagaatgatcactgcattgagcccagctgctgttgcccatgtgccagccagaatcatagtaattttccatagtcacaatggaaaccattctaaagtttcttccatgatttctgagccttttatctcccatccctagttactgtttgttgcactaataatggtcgatcttcttcttatcttgatggtgactggtgagataaccaataccctttcatgggtcaaaatgaaaatcgattttggttgtacctgtcagtcacttcaccaagaaatttttttccctccactaaatctaacgaacttggactttataaggacgaaaaatatgaagagtaaaagaatataattgagctgacctgacttaataagctaatagcctaacattatttagtatccgtgctgagtaagaatttgaatgagaaataaaatggtatgtatgagaagtatctggcaaatagacttggaaaacactgttgtaacttcagcatgtagttgatgtagtggatggtgatcagttactcattgtcttatttttattggaccacagagtgttttatgtgatcttgtgataattatatctattttggtctctcttgatgcatagcataatagatactacctaagaactcatcgttttacttatcttgaacttttgtgtcatagattaattctttttcatataaaatagcagtgggtatgtacttagacaatagaaacattcgtattttcattacatttagatagatgttacctgaaataaagtcagtcaccattttactaaagaaaaaatcatacatcaaccttcatcggttgtttaaatattttttgattggttaatcgtttgataaagtaaaaaagtaggcgccgaagcttacacgaaagtgctagctaggcttgtggaggtggatcccattcatccaagatacttcaagatcttccacattgaattatcgatttggtgaaattaagctttcatgctttcacccatatccctgaacaattattccaaccaaagttttagtccatgtcatgatagccaggatgaaaaaggttactgaaagaaaataaacacacacattggatcacaaagtaaaaagaaaagcccaagatttgctcaatcatcaattggacaaacccatgatgtaaccccattagcaaacgaattgccctttaagttgaagacactcggtggacccattttaccattttcagcgtaagctatggaagtaactggactagtccagctgtgtatccatcctaagacaagatttggtttccttcatgtatcttgattgaaagttgcaagttcaaagcataggactcagtaaaagaaggctaattttacacattttttaaaatgttattggaatgaagtattcagtaattttgttgagaattaatctttgttagaaaatctgattgaccgatcatcttttgggtgatctctcattttaataacgtattttcattgctacaagacttgaatatttaagttaatttcactcgaaccaaagaaatgttataatacacttcgataccactctgattggaaaggttgcttagggttcttgcagcagaagctagcaaacaaagaaggctcaaatacaatgagggccgggtcactactccgtagggcccaatacactcacaattgcaactcataataaagagcatctttaaaagtgacacgacttctgatcaaccactcactttgttagcctccatatatttctctcacaacacaacttgtgtgtgtggttttggtatgattccgtattttcttctttcacttatttttcatcattttttcccccttctctatctgtctcatcaaaggctttttgggtcccataatctcagaacatatctgcagtatatcttacattaatcacgctcactcacatatacacacacccgtcggcaagtgaagtgtcacgataaaaatatggcaaagtaaaatgatcaaagtgaacatagacaacacgtctcttgaaattgtaatatgtcaagaaatgaaacatgtagtatttaagtagcttatgttggaagccaatgtgtatgccctcttgtctctttggctatagagaagattgaaaacttcaacttaatgagaagataatgtaggatcggatccaatgttttcctccatgtttgttgcttatccactaaggaataaggatactgaagaaacttcaaataaatgaagcgtattattgtgcaatgatgctccgagatatttggaatcgtggtgaaacatctcaatacactttgagatattcaggatcatggggaaggggagcactattcggctaggtttcctacatagtatatgattgaattacaatataaatttttatatcgtgaatatattttaattaaattcatgaatattaacatttataataataataatgattattcgttatcatttcattagaataatcacgtaaaatatttaacaattaaataagataataatagaattcaggatacaataaattaatgtttttcttaaaattaaaagaaagataaaaaaatttattctaaagagacaaattaaaaaaatgaaagcaacatctaataaaaagtattatatattctttccaatacatttttgttgttagcaaaaacatataaaaattcacaaaataatttaagtctaactactttgtcctacttataattttacaagttttagtgaataataaaagaatatgatagaaaagtattattctctatcaaataaacattttcatcgtgctgcactgtttctaccgtacacatcacaaacaacccaaattcaggaaacagtagttctttggcgcacggatcatcgatcatcagtcatcacttaaaacttgacccattgagtttacaatgtatcggcacaccgacatattatagtgataaaagctaaatttgtgtgctcaacttcgtacaatttacaaaataataatagtatttataatatataattttttaaatgagttatttaatcataatttcaaccattcaatttttagttaataattataattaatcacattattttacttggcaaagtgaatcacccactttaaagaacacttaaaagaaaacatgcctataatttataattaaaaggaaaaatctaaaatactttcggtcggtgaagtggtaccatacaattatgcaatcaccataataaagttgtataaaccattatgtgtgatgaattttagtgtgtgtacatgagtacttatacgtgcgcaaataatgaatgtgtttataagtgccaaacaggtaggagcattgatagaatagttcttctacttctttaaaattgaatacgaagtcagatactgtatgttcttattatcatcctaatatactaggtgaggagagtatgctttccacccacacctccaaatgtgcaaagggccacttttgtcccccaaaatctcgaataatggaaaaatgaccctcatcttgtgcatatagacttaaaaaaggcatctgaatgttatttacaaactaaattaagcaaaaaaattaaatattaaaagaaatagttttgaccataatgatcttatttagttaaaatagaattgtctttgtcaagttttggacactcttcttttgtggagaaaaatccaaatattcaagttcattttgtgtcaaatgtataggtacagaggggttagagtagagtatataaaagacttttttcgagtgagaatagcaaaaaaccagagaaaaaagaaaaggaaaaaagccaactcgcatactctcccgtctgtcattgtaaattcgtgaccaaagatttgttcactgttgtattgtgcttaaatttcttagcaagttcagcacacgtaattcttgtgtttttaacgattggataaaatattagaggtatagtgtgcaaaattacttgttcacagcagcaaaccctatttcgtgtatttttcatcttcttgtctctcatttataaggattggtgcttggttattttggattatagtaaacacatttcagtagtgtatttattggaaacctttatttaatcatagtggaactatttctttctttagtttaaatgacctttaatttttatcattgcattttgagatttttcacaacgtcattgtgtagtgctataaaaattaatcagtcttatatatagacaagcgtattgcatttttagcatattgatataggtcttcgtattagggaaatttttaattttctccggctgcgggatatactctgtttattgttgtatcattttgaatttaatataatttacatttcccccaaaaaaaaattgatcaggtcatcaacttaattgaaacattgaattattagattagaggttcaatcggtgagtgacccagtgtgtgtgtatatatatatatatatatatatatatatatatatatataatatctaacataatataatcaatttttatttttatacttcaaaattaaatttattgttatgatcaaattataatgtgatcatttattattataaattattttgtcagtattataattaaataactaaagaaaatcttattttttaaaattaaatacaaaagttattagataatgataaataagtgtggtaaaaatatataaaacacagaaatattacatcatatcatggtcaatatgataataattaattattatatattgttatcaagataaaaaaatattataagaacatatatgtcattcgatacttaactattaataatttaacatgttatacaaactgaaaaagaaatattggatccaaccgactagatcagtctaatttcaataactatggtcttgtgtattagaatcgaattcaaaatattttagttatggaacaaaactatatatatatatatgtgtgtgtgtgattatattacttttttaactaaatttaaattatagagatgatttataattatacatacaagttatgttatatgaagaaaaaataaaaatttagggggacaattgccccttcattcacaaagtgtcattagaatatcacatttcatctcgtctttttttttcttaaagatgtcaagttgtcatctttacactttacaaaaattttaaaatctatcattttttttttactttctaaaccttttaaataatttttgtctaaaatatatttcaaattactaattatttgaataaaaaaattaataaatttatgtaaagtgaaaataatggaaaaattaattgttgaaattaccaaattgaataattaaattcaaaaaaataattatcaacaaactaaatcattcattattcataagggacaaactaaaaacacacattaagtctaaaaaataatattttattcttaataagataattatcttttatatgagtactctacacacacaaaaatgataatgctgtgttgattatggccatatgacaataatcatttcattcacaataactattttgtgcaacaccgccttatatatattgcataacttaattattgaaacaatattctttcaaggaaaccaaaaagaaaaaacactgaccactacattaattcttttatctttctatgcaatactatactatgagaattgagaagaaaaatcataatcaatcaaaaacactttaaaaaaaggacaggtacaatgttgactgttgagcatttatatattgtattctacatccaccctgaactaaatctctcttctagcttataaaataataattataacaataattaacttgacaaaaaaaagtatctcagcacctaaaatgtgaaaaactgatcatcaacatcatcagttcaagcagccgaagcttgtctagaaatataaataaactatctatttttatggtaaattcttaacaccacatctcagtactcattgaaatggattgcaccaactttccacacaatgtaagttgttgcaaacatcactgtgctgataaaaacaaatgagaagataatgaaaaagagatcagaacctccaggaaattggaaagtgaagcctgttgataaccctcgtttgctatcatcaaacagattagtaggggcctccggaagtccagattttttcttccctgaccctttgtcactttgttttgaagcctccaacaccctgctgctcaggtcttgtttagatgcttttgattcggcgtatcggttgagggatcgagctgcctttaacctctctcttgcagtcaggttaggtcgtttggttgcagattgtgacttaggagatgcttctgacccttgctcttggttaattgaaccattggaagcctctaatgttggagatcctgactcagcatttacttcagtttgcaattggaaattttcatctggaggattcatgaatgctaactgatcattggttgctgaactttcaacattgtcaaaatccttactgctactgttgtctgcggcaagctgatcactatctgccactgaaaagcaatgaccaaatcttctttccttgacaagctttctcgatctagacactatcaacaaaggtgtaaactgagttgcctttggtaaagaagctccaacagaatatcttgatgcatcctgatactttgtttccaacttctaatggataatgaaagacttgaagtgatcagaaaaatgacagtcaataatatcattaattaaatcatactatttttttttagtatacaatggtcgtgctaaggtttgaacctatgacctcatgcatattactccaacccccaccactaggccgaccctagaggttccacttttaaaaatgtttcttcattacaaggataaacacaataatagttagtacttcattacatgtatgtaagtctggcctttttcttatcaagaataaaatatgaatgttacatcattagcattatatttgagtaaatgaggacacacaggtcataatttcattggttaagtgaaaaggggcaccaacaccctatgagacaaaggggtaccgaagcaatcacctaatatctcaaagtagacacgtaaaggattttttatcaatagctaaagtgctaaaccatcaatttttattatcaaacagctctctgaaccaaaatatagcttaagaagtaagaacgaattataacataactgcagagctacaattaataaatctgccttcactctgacaaaacagctaccaaccaaagctccaccagcaagaaaatttgacagtgtatatacttcagtatagtggcataaagcaagaagttcaccaaacgaatattttttattctacagaaaaaaattactattactaatactattattattatttgactccattaaagacccgagtcaaataattcctaccatctaaaattcagtatgcattcccttgaatctcttacaatccaatacttcaatttcagattttttctgaacctctaactctaacagccaccttcaccaatcaatctccattccttacacaccacttcttaccatagcttaaatccataaatttttctcaaggctgcttaactgagtgctggcaactacaattctttgaattgcacatactatatttgaagttaaaattttcgccaattaatatttttttcttggtttatcacgtcactatgcaatcctaccagcaccaagaatcatttctctgaaatccagatgaataaaatttcattaatctctgagtcctcccacttaagtttaacgcaaatgttgaaactgttgtcacaaataaaattcaaagatgcccagaaggggtatacaaacaatcctcggataatttgaaacaaaaggcaaacatatgatttgagaaaaccatgaaagatctaatgaaactagaaaagctcataagtaaagtgaatggtgaaatgaagcatgataacaagaagcacctaccgttgagctgaagctcacgatggggtttaaagatatggtcatcttcttagtgtctttcaaatcccaaccatagatagccgcaaagagtggtcttcttcttaccactagattgtttattcggaactgaaattgctgttgacacacgccacatagcgcgtgactactcgtttttttttttatttatttatcaaaaagaaaaattacaaattacactcgttttatctaaaaataaaatttcactcgatttctttatttttttgtattttacacaatcatcttttaatttacatacacaaactttttctgagttaactgagtttttaaaagaaaaatataggataaaaatggaaaatttattattctatttggattaaaataagagtttaatgtccatgtactaatagtgtaaaataattctatttgaattactttaagatgattattttaaaagtcaataaatttatcatacatggtgattgtgattggatgattgtgtaaattttttcacacgatttcaaaacagattatttattcattcaacagaaaatatcaccaagatttcatgatttgttgtggaacttatttcaatttaataagagatctcactattatgtttgaagaggacttgaaccttcatactctttacaagagattttgagtctcacatgtctttcatttcatcattaagacatcttgaaaatgaatagcattccatgaatatgatatctatctagtgtgatgtatgacaaagatagtgttagaatatttatattgattaatcatgtcatataaactcaaatcggacatccaattggtttgatataaattatctataagagcatgggtgtataatcattttctcaaataatctataaatctttatactttgttaatttttaaatccgtcattataacaggtaaaaaaaatttataatttaaatttttttaataagattcttatttatatatctatatgtcacaatattttgattttttaaagagtcatatatatagtttaataaaagttaatgatcattactcattagtgagtaaagacatttaaaaattgaaaattgctagtgagtgtcttagactattcattgtggaaaataaataatgtatttaatcaaaaggaaaataatcattatattaaaagtgcaaattaaaacaccatcaaataaatgcatagctataaacttatttatgtttgtttacaggagtgaatttatactatggtgagagtacaagtgcatttcctcattttaaaataatcgtaagttaaaaaatgagaagattataaataaaatcttatattggtattttattccttatatatacatatataaagcccattttttaatatatttgaagtcactaattacagttattatagtttgtcaagtcttagatactccactctatgttttttctctccagtagagagggcaataaagtgtaatctacccttgatgttcctatgtcatttagttgagattgtactaaagactttaggtgattttgggaaacaaaatttaagcttttacttaatagcaattgtaatttgtgacataacggacagagtaaatttagttagtttaacccaaatacttgtgaaattaataatcgaacctttaaatgttaagtagaaagctgccataattaatactattagttatgatttccttaagccattcccgtataccgtaaactaagtactactttaaatgaagacttccaataaataaaaaatgccaggcgtaagagatcaagcagtattagtaccatgaaccaagatcaagcctgaaaatcaggtggcaataaccacgtatttaaaagatgcacataacaaacaaaacatgaagccaacaagcttaaatcaggtagtttccatcacaaggtaaagtggaataaatctaggccatgacaaacatgggctaggagtcaaagtgggtctatttcgtattatactttggacccatcattttaatacaagaaaattggttacatacagaaaatcctcggctagctcgtgcaagcagcccaaaaaaatgcctcaactataaagaaaaatattacaaaaatatggcacaaaccccccaacagaaacttgaaattattttgaactgaacctcctcctccattagaagcaaggaaagaatactgcattaaaaccccagaagaaaatgtttgaaaactcccaagttgctacgctgctctcggtatacacttgagttcattgccgagaacttatatgtcagtagctgcccatgggtggcattccaaaaggaggcattggaggcatccccaatccacccattggagggggaggcgcaaagcctcctcccattccaggcattggtggtgcgggcaaagcaagaggcaacaactgagcatacatattctgcaacaggaaaacattatattcaatcagtattcagtattataaagttcaatccattagtgtgtttgataagaagatagaagttatcaactaggttattagagcaggtaacaaaatgaccaaaactaattacctgttgagcaattacttccttctcttcttgttctttagccttcacttggttctgcgcttcaattttatccttcaccagttcatcaactttgccggtgtactcacggataaactacatcagcgaaagaagaagacaattaattaaaaaaaagcactagataaaatgttgaaaaagaaataatacatgtcgatgtatgtttaagtaataaaagtaagcagcacagaaggaatacaaacctgcaggagatatgggaaggcaaagtcaatcatattgttcatccaggccaattcaagagcaatgtctgcccggatcaaatcatagcaaacaaatagacacgaggcaaagcattctttctttccctgcataaccatgtggaaagaaatattagaatatattgaccctactcaattgtatgcgcattaacaaataagaaaattaaaatacatgggactgtaagataagaaaattaaaatacaacccccttcagtaagtgagtgttggcaataaaacttaacatgaaactggcagaatacatagtcaatataagcttgaataataaaacagtaaaaatgctagttgccaataatttctaactctgcatatgccatgatgagtactacaagtgtcaatattcaatacacaaaccatgacagtttagcatcttagtcttaaaataaaaaatgttaaatgagaatgagtcaacccaaatcataatgctggtctgctgggcaatgttgctaaaaaatgaattatatgccattgaaattgaatttggcacctgatcaatgaaataaacaagcaactcctcagcaagttcacggtcaccagattgcgaggctgtctccatggcatctttgtaaaggttatccttctttgacaaggcaatggactgcttccatctacctgccttcttgtaaatataagcagcaacacgtctcatctcaagaagctcatgcttttcaatctgcattccagataataataataatctatcggtttcctataattaactgaaaaatagtcaacatgaagaatgaatgcagccaaccttctgtgctaggcctatttggtcgaagttatcgtgcaaatcaatcgactcgcgcaatctatcatagtcttcctcctcaacatatatttcattaagggcttcattaacagcagacacattgttactctgaactgcaaccatgtatggcttgacaagacggagatgaccagcctataatacatcacagggaaaatattcatagagtgaaatggaaaacaggttataaagtaaaaattaagatgaaattgttgacagtattaatgctacctttcgcatgatgtcaacaacacgtgcatgatcaacacgaagtgcaaggacattcaaaacatcattgataagatccggatgctcttgtaaatagaaatgaacagccttgtaatacaactctacattagcaactttgacaacaacatctttgaattgcatgtgatcccatgcttcaggtgaatggttcatgatggttgttgcagcattatcgaactcatcatattggatgtacaaatatgtcagctccttccaatgttgttgttcatcacaagctcttatgagttttggaatattgagtcgggtcgcaaatagtttgatatgctccataagcttctcatgacgatatctagcatacagaactcctaactctgtaaagatacccatatgtgcccgttctaatcctaaaccactctccataagcgatattagctcattgaagcaacctctattttggtaatattcactgacctcttccaagtcatccacctaccaaattcacaatgaaaattgacataataagcattggaaagactataaggtaacaaactgcagatttaagtaatgctcacagcatttttttttctctttattcagttgtcatctgatttccccattacattttgaaagaatgtattattcaaactttctaactggaaatcagatgacagctgaataaagaaaaacaaattccagttcatttcaaaatttagtcaaagactaggcaaaaaacaacatattacctgaataataatattaagcccacatatctgggccaaacgaaactcctccgcgtcaacacatgcaaagcaaacttccttccatgtttttgcactgttagctttccttgctgcatcaactgcaccttggaattgtttcaacttcacaagtgtaactgctaacttggcccagttagatataaaagcaaatatgattttagcagcctcatatagttcttcatcatataatcggtcaccaacattttgaagattggctacatttggcataagaatgaactcctcaatgtcactgagccgatcaatctttgcatacgcgtaaatgagctcactgtccaccttgggttcttttgtcttatgccttaccatcaacaagtatctcaccaagtcatggtaagcatttccatcttcagcagcacggataacatccaaaaactgtgtggcatcgtctgctcgtataaaggactcaatggcatcacttactagcccttcccttagttgagccttggctacctgactccaaacagcatcttcttcaactcggaaagcaaactccacagctctatcaatgctatgaatatgatctagcaagacattgactgcttggacatttaagttgaacttcttgaaaattgcaaatgcttcctcatataattgagcctcaacagccatttctccaactgctggcccatcaaaattatccagtctattaatataatccataactctggacggatcagcctttattgctgttaaaataagcagattctgaagattaaagttcccactgaatgcagaattctgaagcacaatcttctcaagaagctcaatcaattcgtgaggtagatcagcagtcatgaaagccttaacagctgcagatacttgttcagggctcttgctttcaggaagagctgtagatacaacctgatcaataagttgccttctgtaggcattatcagggttaagaactttctcccaaagatcaccatccatcctctcaacaacatatctgtaatcccaatataagcatgtaagcattgaatccaaggataattacttagagaaaaaaatataaatatacaccacaaaccttgcttgcagtttgaacaaagaatttttgtttgtcacattgataagctcgtcatcacattgtccccgcctataagctacaactgccaaggtgggatcacgtttctcacaatatttgcccacaacccgagaatcatagtatgggttggtagtgagaaaatgttccggattgttgttgctatcaatgatgattttacccagtgcattgtgaacatgtacatcctggcttccctcacttacaagatgttccaaaaactgtgtaagcaaacgaagccgattcctgcatgccaagtaccacggaataatcagaaatgcgagcacaaaaagaaatgtaggattagagaaaagatactacctcttctcacactcctccacaaggggctccactggcagtaaggaacgaacagagagaatcaagcctttgataaaatcttctggacattcatcatctaaaagctgcccaacgactaaaggagcattccctgggttcacctataaaacaaggcacaaagttatgagtggggcagagaaagtagatactagatagtattcatgtaaaaagcaaggttacagcattattaatgcaaactataataccttctgaacataaccttcaatgtaacgaagcatgttgtttgtgtatagatagtgtgttagatccggaacaaatccaaatcggtcacaaacattaatcagaggtcgtgcatctggaagcttagcttccattagaaagttctttgttttctcaggatcataaaaacttgattctctagtcacacgctcaacctctttgatttgtccagtctttgctgctgcctcaatgtacttgaagtgaatgtcaggatcctcactgtcccaagttcagggaaaaaaatattagctgatagcagacaatatcccctttacaaattgcatcacttgtccaccagccaaaacagttctaaaaacatgaaagagttacctggagctcaaatatgatcccaggaaaaaatacagcccttcatatgacctgaactgctcaaaaagctttatgcaagcatcaacgcccaattgttcacaatattctttagcaacctagacagaagttagtaagctttcagtttcaatcaaatattaataattccatgttatagaagacaatgatagttccatacctgcacaataatctgtaggttgcctctaagattgaccagcaataggtctttcatacactctaatgcccattctcttgacagagtaccaaaaaattcaacgagtgactgcaagaattgaacaatgactaagaatttaaaaactagcataatgttacaatagataaattataaaagcaatggatcacacaaacctgtggctcaattgcatgtgtatttacaatcacacgttttatatctggcaactctgtgtaatgctgcaccaaaaatagtgtaatcagtaaaagagaaggcttttgggttaaataagaaaaccagtaataataaaacacatttggtgagtcattacttgcaaagctcgcacataaagaccagctttttcacaaagttgagcaatacgaggacggtcataatggctgaacattccattagccaaaattgcatcagcaacatttgggaaagtaaccagatttatctccaacacctttgtttgaaggtacccatgttctggtagatttggtttcagaacatctagcagaaaggctgttgcctcacggatcagatttctctgaacaggacaaaaaaaaggtaataaatgtactgtctagcaataataattactgtaaaaataaggagaggaaagatctgggaaggtgcctttatgtagaatcagcatgatgccacataaagaaacatttcatacataaaaaaaatgatgatgaagcagcaatattatattactaatctccataatggcttaatcacagtagacaaacaacctgaagaaacagatcagttatggtgttgtaatcaactgggcaacctccctccatttgcgacatcattaatgcaaaattaacagcaccctagaaaccaaaatgaaaaaagaaagttgttgaattagtttttacaactattaatttctgcaaattgagatgaaatagttatagaatttccatgtcagaaaatatataatttgataatcaattatccaacagtgtggcagacaatgggagaaatacaaagaaatagttaatatgaactacagaggattctctcatacctgaggatctgtccggagaattgtttgcaaaaggaagagatagtcaggtgtgtacccaacctgtaccaaaaaaagtaatgaaaaagatcagcacaattcgttccagtaaaatgcaaaggcaatatatgcaatgttaataatacaggccaattaaaacccctataggtcataacaatattaaagaatttaacaagagaagcacaaaacaatctgatgaacaaaaatcagtattatttgatacataaataaacaagcctctacctgcttagagtatattagaatcttgtcaaactcccttctctcagcaaaagcagcaacaacttttggagtagctctggctttgatgtatatttttaaagcaagatcattgtccacagtctacaatggaacatattaatcaaaattaacacaaatataccatttcataataagcaaattcaacaagcagtattatactattaggtaaacaattagaaagaaacaaacgcaaaaaataaacagatcagtttagagtttttcaaaatttcaaatgcaacccaacctttacaagatctcctagctcctcactgcattcaagctttcctccgccaaccaattctccaaaagatttttcttgttctggttcacaaccagccttgacaattccaatgactcaaaggcattcagctttcctcttgttagaagtgttccaaaatactgcaatagtggaggagtttgcccagcttgcacaggaacactctgccacataaaacagattgacacactttaaccatgatagcctaattgaccaagaaaaagaacaaacctaaacagttcaaattccttttatcctttatccctcaaaacaagcaaagatgattgtctaggttaaatttgttgatgaaagagcacgaacaaaatatttgatggctgtatcttatatacaaaacctgaaatttggcaactgtatcaggtgtgcgaaggattccttgcggagactcagcagcaagttcagctgcttctttatactttgtttgggcaaacagttcatggaaacgttctaccacctgtaatgtcaacaaggaggcatgttaatgagtaaaatacacacaaaaaaaaacaaagcaataaaaaaactaaaccattttaaatgaggctattacacactccaatcaaacaatcaataccaaaaaaagttcataatattaaaaaattaagtaaataaaaaaaaaaaattgaagcatggagattccatttataggggaacaaaaaggtaaatgacaaaagtagaaacgtttgtggccatacacaccggtctttgtaatgtaatctttccttactatctatttaatgcaatgccaatttttattgtttctttcatgtgtgctttattgttattgagtggcctaatcatcaatgcatctatttagggaatagtcattgggaagtgtttaatttctgaaaaattgggaaaggatatctaaacaactcattgctagggatagagtgacattgttttgtcttatgcatacatctccaaacttaatacaacttactatttcatctctacaaagggatttgggagagagaataaataaagtaggctcttatcgtgaggaatcaggattgagtatcttaatagatgtgagcgaaaattggaatagcattaaatagagaaacaccttaacattgcatcaagggtagttaggcatgctaggccccaacatattttaaattctaaatttatctttaagcattcaaactcaaaccgtattatcattatctttatcttctacttttcttatcttttaccttaaaatctcttatctattttatcttctacttttttatctctaaatctcttatcttctatattttaaattcctcttgcttgtaaattggggttgcaccaatctaagtacaaacaatcgaactttcattttactttactacttgtgacaatttggtgcacttgtcaatgagttaacaatttccaatgcaatcccaccgtgattttcaatgaaaactttttatttattgaatccttagctagactacatattaaaacattgcacattgtacagcaaccataccaaatactacacatgttagtatttagcaatataaaaccccaccaaattgataacatgtaacagccaatttcttgggcccatcctaagtcctgacaacatcctaatgaagaaatatcaagttcaatatgaaaattgacataccagtttctcagcaccaggaagatttcctcgcttggcaagattaactgctagctccaaattgtttaactgtggtaataaacaaataaaatttattgaaatgtcactttcccactttacataacaaaagtgataagatcagaaacatacctgaccactgacaaaattcacgatcgtttgctcattaacagtagccaacaacacctggcctctcctattaatggcataaaagcctccaacagatgtagcttctgatgtcaaaaatataggatctggactaattctgttcctatatacagctgtagctgtctccaaatcgtagacaaataggagaccaagtttcgttatcacataaatcaaactgtatttgtgggatatctgccaaaagagaaaactatgaatcaaatatctgcacaattttctaaaatgaacaattctagcaacttctgtacctgcatggcaactggaaaatcatcagcaaaatctgggggaaagaaaagatctgcttgtttctttgtaaatgatggcttccctgcaaagaaatttggaaagttaaattccagaaggatgattaaccaaatcaaagatgatagaattatatatatgatttagtgataatagaatatatctatccattttcaaattctcttactgatttcaatatgctgctccctttatttgtgaaactaatcattacagcagcttcactggtttatcattaaatttaaaacccaacaaagcccatcatgatcagattattgaaaatttactatcattcaaacttaaagtaatccctggagcatggcaacttgcctaacaaaaaggtagtatatttcattattattaactcaatctattagcaataatgaataacctcctccatacttctaaaccaatacattatcacctccaattcatccatccacaatttgaagtttatttgatagttattttgagttgaagaattttgaattgcaagacaaaggtaccactctaggcatatctttaagaaaggccatgcttcccccacacctctatttaaaacagtttatgaccaatttaaatctaaatttctgatttaacaggaaaaataagcttggaaactcagtatgggacaactaaaaattgttattttgagacagatttatataacagcaatattgtccatagatcaattaatacaggaggtaaatgtgatagagaaaaaatatatacagacctggttgtgcacccagctcaataacatgcaacttggatataatttggccagcattaagtgttttagtggcaaaagaaatcaaagtagaaggattttcattcccaggaacctgtccagaagacacttcaatttttctagcacatgcatagtatgatagtaacatgatatagtagcattttattcaggtaaatatttaattaacaagggaaagtaaacccagaatcataaagaaacgcactttgaattgagcaaatgatgccgcatgtgcttcaagagcctggctccgctgttgatccacagagaagagttgcatgtttcctttaaccaattgtggcctctatagacaacacaacatacccaaaaaaaaaacctagatcagacttgtaggagttatagtaaaaaagaccatgattgttttcaaggatcaacaatcccaatggcgtaagctagaaaaatcgtgtgaacaatgcacaagctcatcattcctttgtgcttgaatttcaacttttttagaagaacaagggtggcaaggaccaaactccaaatcacttgatcaaggaggctctaataccatgccaaggacaaattgtccattagattacttcttaaggttttcagttttaatatcttaacaattgtaaacctaaataactggagcaagaaacatgataacctatttactatctataacaggcactagagatatacctcaggggaacctggagcaataccaatcaagaccaaccatttctcagaaggatcacatctataattaattatttgattgtttgccaaatttgctgttctctcaaacatctttacaggttcagagtcacctacaagttacatatatcacagacaaatataccgattagcaaaataacactgaacagcagtgcaaaaactggaaaacggcacaaaaccatgtagttaagcagaattgaagtttatcattgtcttaccttcaattgaccaatggtatacagaggtctgtgttacaagacccaacaacttgggggtaatccacttccaaaagaccacctgcacatgaaattagagcattccacgtggattaatagagttttcatcatcaaccatcgcttaatagtgtttgtatactcgtgcataacagttacctgctcgggcatctgataagatttcatctttgctttcatttcaatgttaaaaatttgtaggtgatcttgagttgttccttggagttgagcttcaagagagggatgtaacttagaagggaatataatccaaaagcaaatactaattaaggtacaacacaaacagaagctatgaacattgagccattttaactctgactaatttcttttagctaggggcattttttttccttaaaatgtaaccactttcatggttgtcaaatgatgataacgtgaataatatattatatatatcatcacaatgtttaattggctttatgtgaactgtgaacggtaaatatattatctgaacaataaagcatggaaaaatatacctaaggttcatagcattacaagcaatgaagtccataataaagtcatagcccattgtggactttccataatagtcctattaccataatgtgagaacgaaaaacaaagtacaatagttttcttctctcaatataattatatcacttgaggacatgatcttttgatgtcaagtatcaaattgataaataagaatcaaacaaagatccctgtttcataattatgtacatcttacgatcaagatgcttaaagacacgcacatttgacaatctagtaagtagaactaatgtttcagaagcaactgaggaccaggaaaccaaaatcagcccgggctatagtcttgttcacctaagtcataataccatgcacgtagtggatatgttattccactcccagtcaaactagttgaaactaagcgattcgcattatacaatgatggaaacgattgcttcaatagctaaaacataaggaacgtaagtttcatctctccaaaaaagtaaaatatataaagaatttaagcttccaataaatcttgatatctacaatgacgtacgaaattcgaatcaataccaaaataccggtagttatattatccacaaatccacatcatcattactagccacaaacacaagtcacaagttcatgagaagaatacaacggaatagtagccaacctttcaaagcaaggattctggaatttggattcataagagcggaatctgccgtaataggcctcctcaaaggctgattcggcatgttcatatcaatgataaccacactattctgcggagccgtttctcgaacgcatatatacttatcggactccatcgtcacatgcgtgaaagtgatgaactgcggatttatgccaatgcttggcaactgcaatcacaaataacatcactctcacttcacaacacacgctaactctacagtttaggaaaaacacaagaaacatctagatctatgcaaactgaaaagcaagaaagtaaagtagtgcagtgaatgaacttcgtaacggcaccgatcgaatctatcgcggaatactcaattcgggagagagagagaaaaaaaacagaatctagtaaagcatgatagttattattctactgctacttatcacaagatagcaggttttgttgtagttaagtagcgaagtggagttgcaaattgagctaaggaaatagggagaaaaaggaagagtgcggagaactcacggtgagagcttctctcatggcgatcggagcgttggcagccgccatgacggcttggatcggagagtgagatctgcggcggcgaatgaattggaagaagaagagtcaaaagagtgatccaaatcggtgcgagatctggaagcaagttggaccctctaaagagaaaagcgagagagatctacgggggagaaataaaaaaggaggttcagacactaataaagcggggaagagaaaaaataaacgacacagaaacagaacacaagtcagagtcttatcagctaataaagcacaattagcaaatttacgggaaaaaagttaaaaacaaatgtcctcattatattagatttacaggctagcaagtagcagttagcatggcagagatgttagtaatttgataacgattataattgtctttaaaaaataagaaattaataaatattttagcacaaaaggaaattaatataaaaatattaaaattataacatttttaagaaaaatataacagtaaatattattttaatacaaaaattcctcttttattttttagttattatttttaagacaaagattaacataactgatttcaaaatagcttagctttgattttacggacagtggaatcgggtaaggacccaactaattctttttgctttttcaattttcattcgcggtttttctttttcaatttatgttccttaattaattatataaaactacaagagtttgtttgatatgagaagatatgaaagcaacataagaaaagtatatgataaaaacctaataaactctaatcctatataattttgatgcgtataaaatatcgaatcagatataatttcaactatgcttaaataaatattatttcgttaaaaatatatataactttataaaaattaacttttaatttatttttataaattataaaaagaaattatattttaaacaaaattatgccaaattgtattttatttatgcgattactttttgttaaaattataaacaaattacaattattgctcaaatatgttttctaaatatttcaataataattatttaatttttaaaaatttaattaacaatttaattttataatttaaatttatgtatcaaaactattattaaataataggctgattaaaagatataatattatatatatgttatataaattagtattagtatatattatatttattatatataaatctcatattttgcataataatattatacatattctatgtaataggctaaatattattataattattatatattcgttatgagtttaattacctgttaactaatcagaaattatcgtaaataattttttaaaaaattattataaaaattaacaaacttatcataaataataatttataattaaaaaatatataaaattattttacaagtgcatcatttaacttctcatatattatatataaaaagaggggtaaaaggaaatttatcttatcttattgatcataatttctcatatattaaatcaaacgctacgtacaggatctttaaattgaggccaaaatagaacacgcattcatgagtaaaaacaaaagcagcaccaaaaacagcgcatatcattatcaaatgtttgaacatgaacacgaacacgaaacactaacataaaaatccagccaacaaaactgtaacaagatgatagtttgtatctagctattaagataatcaatgtatcaagcgcgatcacaaattcaccggattaaaaaaaaaattcctcaaaagacacggtaagatttccccattgtactcttcagatacaagcacctgacctgaaatcaacaaaaatttatgtcagatggttgtctggctcaaccagattgaatattccatggacaggaaagaaacaaaataagaaaaaatccatatacaggactattgtaggattgagcctataaagatataatgaaaaattgcaagttggatactgccatatatgttgccaaagtcatccaaggcaacaaattcaacaaagatgctaactacaacagcattggcaaaactttccattcactgatataatcacattaagagcatattggacgagaatattgcagaaaacagaaagaagagacatgtacaaaagaatcttgtcatcatctacataaccatataagcagaagataaaacctgtgataagcatggattcaatccatgccacatctgatatcaaagactattcttatagtagcagagctttttaattacaccaataataaaacagaaacaagaacatataactttaagaaaatcacatcaaaaaagaaggcaccagaagcaatgacttaacaaaatattgatagtggactactactcacattttgccagttctttttcaacaaagagacaaggaaattaacactcagttgaacattttggaagatttgcttttcctccatactaacattccccacagctactcccatgcagagcaccttcttaagttgaaatttaaccatggccttggactcgttaacctttgactcaagagtttcctggtgagtaacaagtgtagggaactttcctgcaaggttttcacaacataacaaaattaactaaagttacaagaaagaaacacactataaaaattctttcaaacaaagcaatccactatatatatattccgtcgtttgaatagagcatgaaccagaggaaacagggagtcatttcagataacataatgcagttcatatttaccaatatatatatatatatatatatatatatatatatatatatatatatatatatatatatataccacaaacgacggaggattaatgaaagactgcaatgttttcatgtaaaaatgatttaaaaaaacagaagcaaatcaccaaaaactctcatttgtccgaaaagttcaaaatccaaaaccgaaaaaaaggcaatacatgcctgccttgttgagaccaggacccaaaagacgaggaatctgcttaatgactgcttcagaagctaaaaaggcatggtactttttagctagtttcttcaccaacttcttatttttgtttagcttcttcagggcttccacatccatccagtccagtcctatcttctccgcctacagataggagtaaaaacattaacaaaacaaacttggcaactaccgaacaataattatgcaaaaaaatctcttcaacacacaaacataaaaaaactcagccattgagtccacatggctgacattcctcccatggattgcaataacaaaatcacagaaacatagtcatttcaactttcaacataatgaatccattactgacaatacatagctttaccgtaaaaatcaacatgcaatcaaggagctaattatcatgaaatagttatgaatccataagagtcttgatgaatatggcaaatagagacctcttcaacatgctgagcatcaccaagcatgcaaattttcatcttggggcgagggatgtggggcagcttgacagagccactgaaacgcttgtccttctgtggatcgtagtttttcaacccgatttggagttcgatggtctccacaaatttgcgattcttctccttggaatcggccatgattcctgaaatggcttcacgcaaagcatcactctgaagcttactacaaaaccagcagtccagcaccacacaaaaacaaatcagaaacaccacacaaggtagtaaaccctattgttcatcaatgaaaaatgatgagcggtattgtacacaaaacgaaacgcatgaacgagcctaaaaaaatgtgaacagaggcaagtagaagaagagagtgtaagcacctcatcttttaaaatcggcgaatgaagatctcgcagagctgtgaacaaagaaaaaaaaaatacacgatacagaaaattgttatcggcggcagtgcaaagcaatggagggataaaacccaacagcagatgttcggggtagaaaaaatacctcgagccaaaaccctagttaggttactggccaaaagaatcactatataccatggactggagaaaatgagatgggccgggcctggtttccaaataattgaagcgggctttgcccaattatctttatgttgatttgcggcaattaatatatatacttctctttttattaacatacctccgtttttaactttttttccaaaaatatcctcagttcaaaattaagccttcaggaagtgagtttacactcgagaggaggaatcatatccatattgaactcgagctaaagcgtagtccactattttttgaagattataatttcttttatacaaagaatttgggataaatgtcgttctaagaattttagatggatcaaatttgaagattcatgcgtactagatatgaaatttagaaggcaaaattattttgtgtgcatgtacgaagagaggaagggtttgtgatagtagatattggaatttgaccaaagctataaatttgttgccaaatcgaatgggactcatgaatttaaattgtgcaacatcaataaaattgttgcattaatatacgtatatttacctacgagagactattttaaatcattagttggaattggtcaaaagcttgtaattaaaaatgcaaatgtattgaatgtttaccttaggatttcatgactcctatgatgtgtgtgcgccttacgtgagcatgttcatttatttacagttgagcccaaattttctgtaaaataaaccggggaaaggaagggaaaaagtttgtctcctcaagatattgtaaaactccaattcatgaccatcttgaatttgtttttattttaccaaaattgctgagggaaggggtatcgtcgtgaaatggtagttgctttatccaagaagctcagcgcctgggggtgagaggagaagaggtaacaacatttggtttgccaaaaggggaatttatttttgagttaaggatacttttggggaaaaaaaaaaaaaaaaaggagctacattaacaaaataggaaggtgcgtgtgtattctcattataaaactttgagcaaattacacttacactctttgagattagcacttaatacactcgcaccccttccatattttcaccctagaaaaacactccttgatttttgaaagttcattacacttgcatctcatacactgtcccagagttgaattcatttaaaaaatgccccaagtgcattacatttgcttgtttaatgaaatatttggacatttatgccttcttcttcctcatagaacctattaaaaagggagcccatgaaataaaaaaatctaacacattttggccacaaaaacatatgctcgtctgtttttcttttgtgtgtttcaatgggtcattgaaggtttgttatctatatctccattattgcaataaccctcctttttttggttttttgtgttgtctatatctccctcttttcaagtgcgttttttgtgtgtaaagtgatgcggatgaccttttttgggggttatggaatcacacattttttgggcttatggttctattgggtgttgttgggtgttaatgttgtgttttctttcccaaatgaaaaatggcatgtttttgtgaagaggtctttaatgttttttttttcatgtagagtgtttgacaaaatgtcttagtcaagaagtgttcttctagtagtgttaatggtagtgcaagtgcaatactaatgaaacaccaaaaatagtattgttagggttgtggaataccgatggaaatcaaatgtaatgggaccgttgcaaattcaaattgttatacatgtatgaacatgaattttaataagtttgtacgggtggagaaacatgttaatgatgactattatgcgttgaaggcagagatagacgtgaagcgggaatttgtgataatgaagacaaagttgactgttttagaaaaacattcattatgttaattgtgattgttgctattttaggtgtagttagtatcttcaggcaactaagatagctagttgtttatttaagttgtcatagtattgattatgcattactatgtttgactatgtgtattttattttgatgttagatgagttattaatgtgaagttattaaagttgttcatgtttatcttattttttatagcacttaagtcaattgaaaatcaatgtaatgttggaaaataaaagaaacttgtgtaggtgaaatatgaaatatgaagccatgtatagtatgtagcaacactaggcttgtttttcattaaaacaactcctacataacatgaaatatgaagctatttagcaaaagacaagcctatacttgaatgagtttgtaaaaaaaaaaatacatcacaaaaagtcattaacatatcctaattcctaattcttcttttggctcaaattttcgctctcttcttctttacaccttcaattttgttggtatttccatcttgattggaagattatcctacaacttcagaattggtgtgtgatttcaaatagtgaaataacaagataactcacaaatagttagtgttgagaattttatcttcaaaactgattggtttaaggaacacctaaaaagtgattccaaattgttgggtttgaggaacttcatattggtttcaattggtgttttgaagctacacaaatccaactactcatgtgctacttggttgagagttttgagcatggacaggtgcagtcgaatgtgtttgggcaacattacggaaaacatgtcactaataagatattggtaatgataatcactaaaattaatacaggcaattaactaagtaacctattttttgttattttgtatgcttacaggatccctttggcaagtcttgttattatgaccaaatactttgcaagtacaacaccgaacaatgcttgatctcctagcttgttgggttcctgatggtccctaaacattactttttctccaggatttcctaggcctactaagaaaccttttgataattgcaaaatttaagtttaattgatagtcaattttgactaagaataattagaattcctttactttactgttgtttttaataaaataatgaagaatttaatatcatgttaatgttttactagcaagattcaaaagaagaaaattacaagtgtttcggaggaaaattgatgcaaaaacgtgaagaaaaaaccttgaaggaaaagttaaagattggaacagctcgcttagcacacaaaacaggtccagcgcgcctcttcacttagcggcctgctcaagcttaacgcgaagaaggctcacaaagaagcccaaaggcgcaaagcgcgaatcccgcgctaagcgcgtgatcaccgtcatactcgctaagccgagaaggcccgcttagcgtgaggtcacatgaattttaagctactttaggcctataaaaagagtaggaagcaaaggagaaagacacacaaagaatcagagctctctaatgaatacatcaaaagcctaaacatctctaataagggaaactctccttctatagtcattcccccttctcttttttttatccatttcttcccttcttctatctatatcatcccctaaagtgtaaatctcccatggcgataagagactaaatccgggagcctggcagaccaactcttgtaatgtaattatttcctattatctatttaatgtaatctagtttttattgttcttttatgtgcttatttgtttattgattatggtctgatcacccatgttcatttagtgtttaggggataatgcattgaaaatggttattttctaagaacagaaaaaaaaggcatctaaatgtaatcattactagaaatagagtaatatttgtttagtctattttatgcatatttaatcttaatgtaatttactgtttttacctttgcaatgaaatttgggagaaaaaaatagataaattagactcttcatgcgggaaatcaaagatagagtgttataataaatgtgagtggaaattgggataatattagatagaaaaaattattaacattgcatcataagaagttttggcatgctaggccccaacatatttgcattctaaattcatcttttgcattcaaactattgtttatttttcttgttttcttctcttctacctttgcctttaaatttcacacttacaattctttatttcttctaatcttttcaattgcttaaaaattgggtttgcaccaatctaaagtacaaacaaagtttccataaatttgacacttggacctctgttttactatactacttataataaattggtacacttgctaacgatatcaaacaagaaaaagattacttccactgttttccctctttttaatcaaatatgatattaaatcaaaatctgtctaactccccaacccttccttccattaaaatctctcatttctctttctcatttaaaccaaaaaagtttattaatcaaactagcttgtaagctagtgaaagtaatttataagctattaacatgcactcttaacaggtcaaaataagaaatcgcgactatgatccgaatcaacattaaatttagaatgatacaatttattccttaaaaggtgattacataaattatttgagtagttaagtttcattccaatttttatttttatgtgataccatatatgtaaaataaaattagttgacacataaaataaatgaagcatttatatataaaacgttgatgtaccagagtccaatcacattcaatgtatgaatgctttattttctcttcaaggattcattgtacaattcatttgtttgatgtgcttccgacctcagccaaattggcttaacaaagagacacaaagaggaaacaaaaggggaaaaactaaaaaataagtcccaagtcctagatctcaatctacaagaatagaaaaagctaaaaaaaatgtctcaagaaaatttacaacttacaagggcatagagacaaaactaacaaaagttgaggcaacgaagcgaagagaagaaatgttttgaagtaaaaagagaaaaatgtataacaatcatgtaaatagaaaattgaggaagtaaagagaaaaaaaaataagatatgtgaaaatatgttatactctgttggtcaagattgagagatgatacgtgtgtaaagaaattcattccatgtatcaggtaacccaggtagacaccaatgaatacaatctgcataagttgcagggtcggcttgttgttctggagttaacattttgccttggcgtatggtgtaaacagatgtatgtgcatcttttctaaattctgataaggttgtgatgttaaggaagttcactggcaccaccttcattgattgcgtcacattgttggcaaccacaaaaagtcgacgatctgtgccaacttgtaatgttgttgacatattcagaattggtatggtctccttagcacattttataccatctggattgttccaagcctcactcctacaaagtcacatatggggaaattattaaatgttaaaattcctaatccataagttgcacacattaataaactataacttttgcaaccatggtaatagtagtgggtcaccaacctaactacctacgatgtaacgtgtaaacaccaatcatgctatttaattagataagagagaggaaggcttcacctaatggcacaacaattcaacaaataataacattgtagtttttgaggattgcatgaggatttgttatagcagttcagctatttataaatgagacaaatttgataacctatagcagagccaaaacagtgaccgtgcacaactacttaggttggggacagcaaagtgaaataatccatatgcatgaaaggtgatgaaaaagcaaactgctaaataaaattagacacgcttattggtattacaaaaagcaattgtatagtttttgaccatagaatcactttttttccctaaataaatgaaaaggaagaaagtgattaaggtttgagcattacttaatatgaagaggagacatgctggagaagaaaactttggtgcgatttggattaatgttgtcttccacccatttagaccatgtgttgaggactcttccatatgctattggccgagggacttcatcgtactccgtggatccttcatcaaacgaccctcgtcttttgcatatacatcaccccacaaacacaaaacgtacacttataagattcacacactttgattttttgctccaaaaataagatacaatatatatgaacggataaagaataggactagagtgagtatatatatgtgatgcttacaagactttcatagtggcagtattcatccaccatatgtaggtgttgaagatcagatagtccacattcttccaattcacagcatgcttctcaattgattccggcatgataatacggttcaatatgctgtgcatctttggatcatctgagtttgactccacaaggaacggtgcccagtagaactccaccgtagcattgtaatcctgcagacacacaatcatcggctaactaattaatcaactcgatcaagtgggcctaagctataatatcatataagggccaccattatgacttaaggggtctaacttagttggttaaacaagagtgtgtgttgttataaaccttgacgttgttgtctttgttttcattaataaaaaaatcatataaggtccaccttatcccacgacacaacatatatatatacttccttaattaccgggtgattggtacaatattccaaagccagagcttgcagacaaaacccaaaataataaatatatagttggtatttaattgtatttaaattggtcaaaaaattaattcagtggtccactattgaggcacgccatgatcctgattgcattttactagtcaattagagtcataattaatgaagaggagcactttagtagcttgatattaggctcgtgattaatcaataatcattaatgtcaaattatgccgacaaaaatggccagccatatctcccctacttttatccgtatcctttttcataaaaaattaagtaacgtggacactttctcagcagggattcaaactggtgggaaaaaaaatacaacaatgaaggaaaaacacgaacctcaattgtgaagatagaaagagaaccattcttgctcaaactttttttgccttgaggaacaacagactggaccagacaaatcattgattcccactggttcctgttcagtgagtctccaacaaacataagcctcctccctctaagcttctcaagcaaaagtcttggtttgaaccttgataagttcgtacaaatttgatcaattaattaataacaatattattagtaaagcaaagagacagaatttagaaaaagagaagacaaagtgaaagaactgaagtgtgtagtgtgtagttacttgggcaaagagcaatctctgggctgccatctccaattctgatagagagaatcacttcttccattcctcatgcaggtgacttgtgaagtgaggaattcgcattggtcttctttgtacaaagggtgtgtcaagttatcaaaaacccactctcctgtgaacaagtcacactcttctgggggcaacacaacctcttcattttcttcctcatactcttccactatcttctcttctgccacaacggctttcaaatcaatcggttcttgagattcctcggagtcctcgacccggtttctctctggttgagttcttgaattgttgttggaaaccgtttcttcttggatttcttgagccttaggcctcaagaaagtgaactcggccattgacttaacgtcctcgttgtacatgaagaccccaaagaggaatatggagaacaccaccacaacaatggagatgctgatgctgctgttccttttgcctttcattgttgttgaggtttctgagttgggaagattattgttcttgcggcgaggaggctgcatggaagagagaaagaaaagaatggataacaaaaggctttagttcgatgctgtgcaaggaggggggagaaaggggaggaaatatagagaaagaaatgaacaacattgagatagagaaatttttttggaataatttactaatttagtattaggttgtgtttgttttaattggggttggtgaaagggtgttgtctttgaagaaacagctgggacagaagagggtgttgtattggtgaagtgaagaagggttgtctttctcacgttaccaagttctgaattttttttaatgcctatcatccatttacaaccgctttgaacgtttctccctcgttttcagacaataccgtgagagagagaagagtgatctcaaagccttcagagttggtcctagtctgaatcagttgaaagggtgcatgtgttgtgtggtgaagttcaggtgctttggtagacacaatgttattatctttcagtttcagattgcataaggctgtgctttgatcattaatggtcagagaatggtttttctttttcacttttcttggtaaagtgttgcgcaggttctgctatgtgtaacccccaccagagtctagaatctgttaagtcaattgttatatatttctagtccaactaatatttacttttagtctttaaaaattaaatgttttttccttgtttatgaaaatgtatatattttggtctttattctttataaagaaaatatatcacatattgatttctctaagttctagtattcatctaattatttaaaagaagctttttttagtaataaaacttaggcatacccccattcataatttccaactcccccacttttgaatattagaatccttaaaagagttgttataactctcagttttatattttctgctctgcctcctatttccacctttttaaggaaacaattgtttttattaggtctacctctatatgggcaggccccatgcacaaaccatttggatcgatttgctcaagctcacccctcttatcacgatcgtggatatttcatctttctagttggtgcaagtgcaactgcataagcctcttcttttccgttaacggttggagataaaacttctttgtagactatcactgtttagtcgttcaactagttgtgtttgacataacatataaacctaacctaaatcacaatcgttaaagctaattaatctgtaatacttttttaaaagcaattattcaaattatcagtatctttatgttggagaaaagtaaaagctaaggaatccattgtgatttttataaagagtattgagtacaccggccacttgtttattgttatctacttgccaacttcacttccattgggtgtgttagtttgatggtggggacatggctttttttccaagttaaggcaatatgcaacgcaagaaaagctataaaagtggtaagcttcaagaaaacacatacatatatgtgagtgttcgttttagtttcaaaggcatactgctccaatcatcgaagttagcttctcctcagttctccccaaatctccctcctcaccttcatgttcactctttcaatctcttttcacccccggatcaactttcatcataacagctaagtggcaacttcacagggtaaaagcacaaacacggttgatccaaaaagtaaaaggattaactaccccctataaatatataaaaaaatgatcacccaatcttatctaacagaaatataaacaaggatataaggacagaaaggagcccttaaaattatatcaatggtgtccaacagtgaaagattgtggatcagatattgacatggggatgagcaaaaactcgtgtcacacgtccactggttgttttaaaatgcaggtaatttgctttcagtttgaggtaggtctatctttttcggtacagagggggaaatcacaagaaaaaacccatagtagatcctacttttcacgtcaatttccaacttcattggcattaatatgcatgcccaactcgcatcgtctgcagtttgatgtagttcaaccactcatgactcgtgagtcaatcattgcagggagatatttcaatagcttccaagataacctagtatgtactaattattacgagtcaacaatatgtagttttccctttactcccagagaacccaaattcttgttgcatagatatttacccagtgttatgttatttgcaaaccaaatttcacgaaataccttctcacttatctgaaaaaataaaaatatgcagaatatataagaacgtgtttttaataatattatctaatgatgaagtagtttaagaataaaaacaaaatttatatgcaaataacattatcctttttaatcgtttaagatgtcagaccatgtagattcccatgtttggcatttaagtgcctagacatgttttatgagtttgtttagttgcacttgagagtcttcatggtgttcaactctaaaaacaataagagtagaattgcaatgaggttgtatgtagtgataagcaggaaaaatgttacaagacactaccatttttccaaggaaaaagtaagctaataaaggaaaagaaacttttattcggatttttattaattgtataaaagatcgtactgatgcattgtcccccgccattataatattctcatgcctagaaaacaggtcccaaggaagaacttcagatatacaatcggatttgaaaacaaaattgcaacaatacaacatgaggatttttccaaatcacaatatttcttttcttgagactcataataatttaaggtaaatcaatactgaaaagaatgcactgcattcatgaaagaagctattcttgattgatccttacggataccatctgatgcacaaatgccactgctgacatccaccccttcaggcctgagagtagatagagcctcagaaacattctcaggatggatccctcctgctaagagccaaccatacttgcttttaatgtttggcagtttcaactggtcccaattgaatgctttaccactgcaaaatgtcttattagttctatgatattaacatgcagagggaaaagaagattatctaacgagcagatggacattaagctatacaagatatatgcctttacctgccaccctttgcactatctacaaggacccaatcaactagagagcactcttcatcagaaattgtgtttaaaaggcttccatcctcatttacatggagaacatatattacacgattttcctgaattaaggacggaaaagctaaccgagaaccatgtccatgaagctgcattgtccaaatataacaaaattaagcatttgattgtcatggaacatacattaaccttgggccaaaaattacctgaacaaattcaaggtttgctgcatcagaagctcttagaattgtttcagaatcatcatccacaaatacacccacaggctctgctccataatctcttgcaacttttgatatctccattgcaacagaaagcgaaacagaacgttttgagttaggccacatgatcattccaataaaatttgcaccagcttcagctgccattgcagcatctttagctgaagcaatgccacacatcttaacaaaaggttgacactttccaagctccttagatgagcttgaatcatttcccacttcagtaagtttgcaggaaactttatgcttgagacagaaccttacacttgaaaattgcaacttctctcctcttaaacctacagaaatcacgttaaaacatttaaatattgactccattatgaattatgacctagtcaccatgcatggtcaatgcaagcaaagacatgaaattaagttcacatggggattgtgctactttggtttccacaaatcttgagacgtataccagaagaaggacaaagaattatatttttgaaatgcaaaggaaatgttattaaagaagaaggacaaagaattggactaccagaaattggtctattgtgaatatttgcagctctaagttgcaagtaactcccagtggttgaacctgtacaaaatgaacagcaaaccttgcaaggtcagcagaactctttttttttataaaaaaattgttcagtttgacataagtacatggaaaattctgtcactgatgataacttgaaaatgcttaaatagacatacgcctcaagacaaatttgaaatttgaaatatatgtataaaatataacacagccttaacataattgtcaagaaactgagcatttataaagaacaaaggtcgtgtctataaaactattttttatgactaataactaagcattttaccactagaaaataggcctgtgcatggatcagtttttttaaaaaaccgatctgatccgaactgaaccgatttaaccagtttggattttaatccaaatagtcaatccactttactgaaccggttctaaactgaactggtttgatgaaccacttttgaactgattttttaaaattaaaccagtttaataacaataaaaggggacaggtacgagaattgcgacaaagtggtaaagcaaaagagagtcaaaattcgaaattaatagagcaatgggtattggatcaacctgaattcacaaaaagaaaaagaagaaagatttatgaatttggagttcagggtttagaaattagggcgagtttagaaattgggtttgggataaatttaagaattgagatttggcaaagagagatttaccaatttggggtcttgggtttctcattttcggttcgggcttcgtgaaatcagatcgaaattcgtgccttcaatggctgagagaactgatactttgtatgccttcaatggttgttcgttgaacaatgctcgtggtcacgttactaacctaagagaagtcgtgggatacactcttttttatgacggtaatataaaaaatcatgtctgtgtgaacaggataacaccgaatataagaaatttggggatttccaatccctacaaattgacagagcaataaatcttttgttctacttcttctatccagagaaactagtcaaacagtctacagcaacacgaccatatgcaatgcatatgcagtacctacactacagtataaatgagtctcgcaacaaactactgtttgattatcacaaaatcaattcaggtagggaattcatcaaacatgtggaatgccaggtaacaaacactgaacagagagtaccatttaacatgaaatgggtaaaacgagaaacctgaaagcattttggccctttggaacggtgataaacccgtcgctgggattcaagcaagggtttagaacagagaagtaagcatggggagggtgaaggtgaagatgtgggtagtttgggtatttccttgtgaagagaaaaaagagaaggaaatgtaaatagcaatggaccaaatgcaccaagcctgaaatgatatcaagaatcctgaaatgatataatttcttttttaaataaatttatataatttgatatatgctcaaattattatgaaatcatagacaagctatctattttttttttcacagttccaacctaacattctaatggattgaaagctggattcttagtagagaaatgttatttatactacaatttatacaataatctttatttgtgtccatctctctcttgcacttcatttattatatgcatttttttaaaaaaatttaaccatcaattggcagctcgtatatagagattagggttttaattccctttatatcctattacatcccttaacacgtgtgagtgaagtttgttttgccttatatacacgggagaatagaaactctaggacgactgcttcgatgccatgacaacttgtgtggatgatgtttgttttgcccaaatgaggtcctaaaggttggggtaaaaactcaagatttagcaataccatcactactaattagtaagcatatgaatatattactggaactcgccagtgctctgttttttttttttttgacaaatattaattgttattattgttaatttttattagtggaaacaagcactctctcctttttcttttcttttcatcattggatcaactttatatttttgtgctagtgctctagtgtcactctgctacttttgatgacactttgtagtgtttcatattatagttctgttttgtaattaagttctctttttccttagttattgtgcttgtttaaaatacatttggtggcaagagcatagaacgttataaattgttcttgttccattctccgagtctgaggtgttgcaggaatggccagaagaagtatatcctccttatgcaaatgggcctgcatatataatttctagtgatattgttactttcatcctatctcaacataaggatactaaatttttatctagactagattttaccttgaaatatatattctgatggcagctgtttaaatttaaaatggaagatgtgagcatgggaatgtgggttgagcgctataacaatactaatgacaacagtaaagtactacaaaatcaatttgcaagaaatagaatagaattttgtaccaatgtttccaaaaagagaggggataaaaaggaaatgagatgatcagatgaagcatcataaactacagtagttctagaccacttccattcggcacttgggcatacttcttctggctgaggattcaattttgtgggtaaattccttgcttcatatctgctctccttcccaggatctctataaggtcattcacttaggtggtggttcaattgaacaaatatccatggctcttactgtcatcaaatagtatttataaatctgtccagccaccaaaataatgttccaggtgtcaaaaactatgctctaacctttttattttattttttattttgcattttgaaaaaacagactctgttttgctttttcgaagcacgggcataccaatctagttctaaacaaactctcaactgcaatatacagttttttattatcaaagtctaggggaggggaaagtaccttatttcatggctaaggtatgctttgatgagagcttatgacaatgaaagtatagtagtagaaattgtacccaatactatgctatcttaaaaagctcaatcttactgagttattagttagcactgttatttacatttgtgtattaggatttaattttaaataatgctcatatcatttgtacttactgctttgacttagttactcatttggcttctttaatttatattaagtgaataagtgaaatttgatactctaagttctttgatttggtcattaattttcttttatctaaaactcttaaattcttattttttattcaaatatttaggaggtttttttttaaaagtttagaggctagagatttgataagagttgaaggatttcataagaagtgacattaggatttgaaagaggagattttgagattttttttaggtgtgagataatgtagaaaatgagagttagagaattttaagtagattgaatttattaattttaaaaggtagatggatttaactggtttgaaaataatatgaaggattaaaattatagttaaattaagggattaaaatgaggtcaaattttatcttagaggttatttttggattttgaattagagattgtaggtattttttaatttattagatcaaacactaattatattcgatatgtgtagttatcacctaaaaaaaattttacatacaaaataaatcgaataggaattttctcctaaatgaatggtttctcctcacattgtaaaaaatgtacccctaagatctcatattatccttacttgcctttatcacattctaactcttccctttttctccctcacacctaccgtacatttactaacataagccataaagtatttttgaaagtacatcctcaacgttactattaacgaataagaccattgataaactattaacgaataagaatattgagaaagaaaaaaaaaatcttgggtttgagactaagggctaaggcctatatcaatatccaggtaacaacaaacattaacaattattagtttttattccttggaaaagttgtcccgcttttctgtaaatatattgcattttttatgtcattttgtatttattaagagtttaataggcatgtacacatcgttagtgtaaagtttttatattatgatataacttttaggatgattattattaaattaataaatttattatatatagtattttatgattaaataattgtaaaaaattcaaattgtcaataaatatactattttctcttattttgatggtataagagtttgataaaagattttgttgcaagcaagataatggattaatgcctaaatggacatgcggacgacaggaagtagatagagagaagaaatcacatgtttaagtgagaccagaaataaaacagtagatttctatccaatctcaaattctaacgaaggataattcaaccattgcacaaacttcgtggttttttagtgttttctttaggcaaaagaagtgcattaataaacggtaccagtggtaccaagagttacaaaaatgcggagaccttggttatggaatatttatcacaaaagatacaataaatagcaaataaccaaagttgagccctgaaaaaaaaaacaaagttgagcccaccaaagcatttaaaaaatataagtaattttaaagggtatatttattattaatttaaactaaaatgcaaatgtatttaactaactctaattaaaaacaaatatattcatttttttattattttggaaggctttcttactttggagatgttttatgagctggcgcaaccatactttcctcatgcatttatcatgacaatgtgacttgtcttgctaaaggatgcaacaaaattggtttataatccccacctttagctctcatgcaaaattgttgaacaaatcacgtatttatcaattttaaaatattaacaatttactacctaattaaaaaaccttgggtggaaaaataaaataacgtgaacactaaataaaacaattgagaaactcgttagaatgggagtttaagatcttaaattttaactttgttgacgctaatgtataccaattaaaacaattgagaacatgatattttatgcacctacatagatcaatagttaactaacattctctcccaccgaatattttggcacatttcaaatcctagcctgaaacttgctatacagagacatcaaaatgacaactcatggttcttaccttttttttcttaatttcaagtttcaacctcctcgaacaccataatccacgaattcttcaaaaaaaatatattataaactacttaaaatgagagtttttatggtgcttccaataatttaagtattttgatattgctatttttttaatcaatcaaattagatgttgccttcttattaattaattatttttttttgttttttcaagttactccttaattattactttttaaaatatgataaaaaaaattactttagaagtctaaaccctataatctttttagttacttttaacactttttttaatttaaaaaaagttatcttcaaagttaataaaaagattgtaggattcaaacttctaaaattatctttaatcatattttttaatttaaaaaagattcaatttaaaaattttgtaacaaaaaatgacatgtaatttaattggttaaaaaattaacaatatcaaaaccctccaaaataggggcactatagaaactctcattaaaaaattgtttactaaacaatactaattaatatagtcaaacaagcgagttttttttttttttttttatccaccagttgttagtttttgactttttattagtatgagaatttaaacttatgacttctctcttttcttttttcaccaccaatccaaccttataattctttatcaaacaagcttttaaaaataatatgtatatttatgaatcaaaaaattacattttagttgaaacatttatgattttttgtgtagttatatgtcaaagtcaacatgtgtaagaatctaaatccatgtttattttaatttactaaataaatattttaaaaaatattaaaaatatattaaaaacaattatttatttaaataaaattaaatcattcatttatttaaattttaagaactttaccatgataaaaacaataataattgatttattaactttttaggaaaatgttttttagacgccccaaaggtgtagacatcatgagagagatatgaagagaagagagataaatatttataagattgataataaaaatacttttagttttattgaaaacatagaaaaaaccataaatacattttagtttttaaaatttaaaacagcacccggtctataaatatgttataattatcaacgaatcctaaatcctgaggcaataggaaaaataataataaaaatattattagaatgtttataaataatgggtgtctaaatataaaatctcaaacttttattcatagcagtataactataagggaaatacagttgataaggtgatgtcacggatgataggggaagtttgtgaggcattgtcctaaatcatatgctcgcagtttcctcccaatttggtgaggcatcgtcctaaatcatatgcacttagtttacactgccggatcacgttcctctgtatttatttattttttcttttaaaaccatcgaattttttttagaattttttaattatgttgtgaattggtaatatttggttattaaaatattttaaattatgaaaatcaatattgtattattttgatttatgttgatgatttccaatggattagactgctcacttagaaagttaattatagtattcgatacggtatttatactatcatataaatttattattataaaagttgtttttttttcgatcagaaaattattataaaagttgttatctcattagatgatttattttgcataattattgggaaatcatatgttattaggtagggaacaatttttttcttattcgttatttcgtttcattaaatcattatatcgagattgtgaaagtgaattcaaacttttatttagacatacacattatagcatatttcttaattaaattatgagatgagaatatgttctaccttatattgtgtccaaaaaaaatgttataccgtatatattatgtaacgagacccaaactttattttcttaaattttagtattattcccttgggtttatttaacccactaccaaatatactccaaaaggaaagcgaacatgtttttaatttcattctcttaattaaaatggtaaagacatgaaatcaaatcatgccaataaataaataaggtaactagaaataatttatcccctgatcgtgttcatcctaaccgaacttgaatgagttaaaaatcaaaataataatcaaacacctataattaaaaaatctgctcattaagtacctgatttgtagattaaattaagataagagagggattctttttggtatatggaggaaagaaaaaaaaatcatccttgaaaattgaaaattttaatatattctttactattatttttttaaaaggtaacatatcacttgtttgacgacaattttgcgagttaagcacaaattaatttattttttaacatatttacatattaaagaattaaatttaaaattactagttaagttgaaataattttaatttatctaattaattcatgtgctaaatgatattttttattattgattaatccttataaaaactagaaaatcaataatagatatttattaaatgaaattttatttttcaatctataacaaacaaatacttaatgtgtttgaattttatcacgctgtcaattcacgtgcttaacatgatggtctatgcctctatggaccacttcgtacgacaacaataataagttaataaccgagtcccaaggtggttattgaatttattttaaactaaataatagtttaagttataatgtttatacattataagttttatacaaatatttaattataaataactatttgaattactttagcataattatttaaaaaaacaacaaatttactataaaaaaatgagttggtgattaaatgtataaaactttttaagtgtaagtgtataacattttactcataatttaaggataatatggtcaagttgtcataaaaaaacaagaagaagaacacacccccacaggaaaataataaataaaccccaccgaattgtctcgtgtcttggaattaacttgcacagcattcacacccttttaaaatgcataagctccacgtttttatataacgtccatttcacttcccttggcagcacggtcccacctccttttccccgtttaacttccaccatatctcatccccacacttttcctcttcgttctttgcctcaaattaaaatccaactcctctttcaattcgcacacacccaacccaacccaaccctttaaatcaaaaccaaaaacttgtttccatttcatacttcattatatatgtatatatacatacatatacacgaattgaagctagcctatctagtatatatcttacccttagacacaacaaattccacataacaatttcatctagcaatgttaaaaaaccaaccacaaccagattggcctgagcccattgtccgggttcagtccttatccgaaaactgcatagattcaatccctgaaaggtacatcaagccttctactgatagaccatccataagaagttctaattttgatgatgccaatattccaatcatcgaccttggtggtctgtttggtgctgaccaacgtgtctcagactcaattcttaggcaaatctcagaggcttgcaaagagtggggcttcttccaagtcactaaccatggtgttagccctgatttgatggacaaggctagggaaacttggcgtcaattctttcacatgcccatggaggtgaagcagcaatatgccaactcgccaaaaacctatgaagggtacggaagcagacttggaattgagaaaggtgctattcttgattggagtgattactattttcttcactatcttcccttgccactcaaggactataacaaatggcctgcctcgcctccctcttgcaggtaattaactattcatatatgttatataaaataggacacaacttacatacaacttgtgttagttggtattgttttccaattagaataagagtttcatgttaatgtttcacctaagtatatatgagttaaaagataattagcaagttattaagatgaaatctcaattctaattggagttctttaatcagaataagaatttcatcttagtagttcatgtaatacatcgtatgagttaaaggtttaactggttattgagatggaattttaatatgaactgtattttatttatatttgtattaaaaataactataatttatacgtttgagatttagttgtatttaagatttttcatttttttttctaagcctataatttgtgagaagcaaatttatttatttttcccacaaactcttgtcaaataagttacactcattgagtcatgacttgtgttttatatataataattagttgtatattattttatccaggaaagtgtttgatgagtatgggagagagttagtgaagctatgtgggaggttgatgaaggctttgtcaataaaccttggattagatgaaaaaattcttcaaaatggttttgggggagaagacataggggcatgtctaagagtgaatttttaccctaaatgtccacggccagagttgacgttgggtttgtcatcacactcagaccctggaggaatgactatgttgcttccagatgatcaagttcctggtcttcaagttcgaaaatgtgataattggattaccgtgaagcctgcacgccatgcttttatcgtcaatatcggagaccaaattcaggtgaatgatctttaatttctctcacactattatccctattcagaaaatgtttggccacgattaaattagtcatcatataaacaaaaagtacacgtggtggggacacgtgtgaagttcaattgttagttttttttttttaaaattaaaagttcaattgttagtttagtttctcctcaaacaattgacgagtcgaaacgtgtcttttacaaattaacagttaagatattttcccgcatatgtttcttttttcctcatttttaaattcgcaccgcctacgtcagaatgatgaaatttaaagtgagaaagtataacaattcactctccttttattagttaaaatttataaaagaaaattatgaaacatttattaaataaaatgtgagacacaactattttttaaaaaatttcaaccagacagtatgtttaaaaattatgtttttagtatttctcatttaaaattagttaagattatcaattattttaattaaaactaatgaaaaatataattattttgtattttattttcatactcagggtaaagaatttaggtaattaatcagttaaaatgattttatatgttacttttgaattaattattataaacttagtttatgataattggatgatgcttttatttatttgtaccaaaaaaaagatgatgattttattgtattcgaattagatttttattttattactttacatatttaattattttggatgaatcgaattcctcacaatagtttaccctggaataaaacgggttaatagttgattatttttctttcaagtttgggacatgtataatataaaaggttttctttctaaaaaaattatgcccacttacaaaaagtggataaacatttgaccgaaaaggttcaaggatagagtcatagctttgatgtgaaaaagattccttgacactatcgaaaaatatatcaatataggccatcgacaaagctatggagtatgtatattgattagttagaggtagagaaaaagaaaagaaacatgatatataaaataataaaaaaataaaaaaagttaaagtaattataaatcaaggatttgaaaaaattaaagttattttttacatgaaatatattattaaataaatcatcttatactagctaggtatagctcagttgtacttttgtcattgctgtgcttttattcatcctttctgaaccgtgaaaattccacagtaactaataaagtgaccaattataaccttactatatgaaagtagaataactgctcccaatcatgtgcaactagcttgcgtttgtttatttatttgactgttcaggacccaataggccaatatgttccttatgaaatactattatttccactctgactaaaacggtggaatattttaatttgtaagaatatatgaaacgcacaaggacaatgcatttcgtctcactacctgacctaaataataataaaaaaaagtcatcacacaaatcaactgtctgaaatgattctcaaataagaaaatgtcagatatttagcattagttgcttataagaatttcatatcaacataatcaagcaaagtgcatattgcttgacaattttccttctcattgaaattcaagatttatttgcatatatttagctgcttaattatcaagtcacaaaactgtattggttaactaatttgtttgttttaattatgtgtatgattaggttctaagcaatgcaatttacaagagtgtggagcacagagtgatagtaaattcagataaagagagagtttctctggcatttttctacaaccccaaaagtgatatacccattgagccaataaaagagctggtaacaccggaaaagccctcactctacccagcaatgaccttcgatgaatacagactcttcattagaatgagaggacctcgaggcaaatctcaagttgaatctttaaagtctcccagatgatcaattctgctcataggcttttattgcttgcattctatgtccatttcaaatagtaagtcactatatatgacgtgtttggtttcacgtctttacagcgtgcgtgcgtgtttagtttcacgtcttggatgtgattttttttacatcttagatgttattttaagaagttaatagttatatatagttttcatgtctgaaatgtgattccttacttctcaagagtttacaagcacgctataccttattggtgtataattaattgtaaatcttgtaactagatcgggatttgtttgcacattgagccacagagtaaggatatgtaagagagattggatatatagatatgatattgttttgaaaagctgttttctactttgctctgtaatgatggctaaatttgatggacaataaagattcttccaaggtgtgtaaataaaactaggttttgtccccacttcacaatcgatgattgtggtgataatgaagcacaccataattttaagaagagtggatatatatcatcatatctggattattaaatatagacactgctgtctgcttgataaaggcatatttcatattcatggtatactacaccttccggtccttttctttgccaattgtttattgctaaccataaaaaaatattcctttcgaaatattagttcatttttttaaaaaactatgaatatatttggtatatcactctagtaatttataatttgatttgatcaaaataagcttattgacacaaacttattttaataacttttggttaattttcataagttatttcaatcatcttataacttataagcgagcaacttttttttatccttattaagttacttttttttttccaatttagaaactattttgcctacactaccacttttaatgatgtcatgttttgttttgttctcatattcacatagcgataacgtgcatcctcaatagcattcgtgttggatcgtcaattgtcattgtggtgtcaccctccttaacacacttgatctttatgtttaagaagaatattattaaaaattaatttaatgaacaaaataagttttttaatttatttttttgaagaagaaggaaaatatcacaagaaataaaaaaacaaaacaacaactatcctctataatataaaatcatcaaatctttatcgttcttttataatataaaaaatttaaaataatttttctaattatatataatgtgtgttttatatttatataaataaaatatattttatattattttacatttaccaattattttatcaattaatttaaacattttgaatccaataaattattttccttagtttgtaacttataagtttttttaaactattttgtaactttttaacttgcttatgagctagtttttctaaacacattataagtataatattacaattttttaatccttataatttagaaaataataacttcacttttgcaattaaataagtaaaaagcttttaaataaaagttatgataattaaattagtttttaaaaattataaatatccaaaaaatggtcttaaaagtaaatgaacaaaggtttaatttttacgtactgtcaattaaaaaaaaaatatatatgctattaatttattatcactctaagtatgacttttaaagtagctagttatttcaaaagccaataaccataaccaataattagattatacgctttttaacactgtatatttatttaaatcaaattccgttataaataaaattctaaaataatatcatgtataacacttttttttctaagttcatctaaatacatctgtaacctacccttacaaaatgaagtacaattctaaaatattacgctgctttcgtttgcaattctaaaataatatcactctaaatttattaaagcagcataatatcattattttagaagcagaatcacatgtactttcgtttagtttttttacaatttgtctttacatgtgacttgtaatcttgtttgttttctttactgtttgaatatttgtgtggatacattcgttattatccttaaacaataattaaaatatgacatgcatgcaacgagaagaaatttaaggacacgtcatactaattaaaaaatttaatataaaatagacttttaagtaaattaatatattaaattagacatgaaaaaaaattagggaaaagaacctatgacaagtaacaaataataagtaagatttaagccttaattttttaaaataggctaaacttatttaaataaaatctcgtttgactcacgctattttcattatccctattcttatcctttgtttaataaaagagaaataaatggaaagaaaagaaataaatgacaaataaaaagttgaatggtttgacagagataaaatgagggggattggaataaaaaagttatgaggttcattattaattccttatcaattcatcacatatttcttttcacctatttatctatttcctatttatttattttcattattcctaaactaaataactttgtttctattctacttcttatatatttctattcaccttttttaatttctagttatcatatcttgtacttcttttaatttttcttccaaccaaacatatttagaaactactcttgggataatcagcagtagtgttttgaatggaaaccctttctggtttcctcctaacctgtggttttttagatagaaactatctataactctcctcaccccttgaaatctctagaaaaatctatcagtacgatttttcgttttatctttatgtaggatttttttttcctaatctaatgtaatgatgtttctgtcatttgcttatctgattatataatctccttttcctttgcaaacaggtatttcgtttttgccactggctgattgattgcaagaacttgtgtccaccaaaatcagtctcatctttttacaaagaaaaattagacaattagttgtgttattaggggcctactcaaactgctgcaaaaagcgccaagttctgaattcaaacttatatatgatatcaccgtaagaagaaaattaacttaggtataatttaaatttattttttagagaaattaacatgatttttttataaattaatttttgcataacttaatattaactcaagaaaaagttctattttaagttttttttacaaatatttatgaagagatttatctttaaaaaaactctaaataaattaaactaactccattataacctgaaaattaaaaatataaactatcccagcaaagcatgtacaagtcctcatagaagaattatcagcatgatttgaagtgtcgccatttttttcatttagatatatgatattctatcttaataatagtaagagataaaccaacaatcattatcatgcagtgtagtttgacttaatattgttttatgtgtgatcccttgataaacaaatgaatgctgacatattcatgttgccactgagctttatctcgcattaaaacaaacggtttgagttgaattttctaaaacaccgatagcgtccaaagttagcattatcaacttttcattaaaataaaagtatacctgttcattctaaaatagttagcgctgtaagttatatatgtggtttaaaagaattatcaaatactcttaattatcacgtgattaattgaaactgtacataaactaatatagaatgctttattttgataaattaaatgtctcatgttacgtacatgatagggcacttttctttgtgtatgtgaaatgtgaatttgtcgaactctgattggctgttagcatcacaatataaaatattccctaataatggtggaagcagttattatgtgatgtggttaacctttcattattattatatatatatatatatatatatatatatatatatatatatatatatatatacctttcattttctttaaaataatgtcgtagaacaccatattgggtttgggttccttttggtaattttcttaatgttatatacattaataaattcatattttttttaaaataactttataatattagtttgtctgaaaaattacaagctgccaaaattttcaaacttaattgttaatactaaccataacttatagacagaaattacaaatatatatatatatatatatatatatatatatatatatatatatatatatatatataattacaaacatattaaaataatatagtatatatcattatcattttcatttttgagaagtacaccctacggtttttctttatttctttagctttcttcccagtttgtcccaccggtgacttgtatgaacatttgtcggataataaagtttgaactgatacttaatacaaaatgagattaatggttatgtattattaatataataattcttatataattattattatataaattttaagataattattataaaagttaataaatttattagatactaatttatcatcagatgatattataaacttgtatgttttatattgttggtatataacttattaatttaaatatttctttagtctttagtatttttttgcttttagttgttgtaaaattatttttttatttttagtccttataagttatatttatttcatttttcatctttataatacttcagataatatttttttcccgttcaaattattgtctaaagtgttttaagaaataaaaacaaaaaaaaaattgtaaggactaaaaatatattttttcaaaaaaaaaaattcaaaaaaaaatgtattcaaacctaacctattttctcacgcacaattcattttattaaaaagttgatgatgaatctttaaataagattaactacttcatcttaaactttttttacaccatattattagaggcaaatattcattcgaaaaattaatggaactttatactattaacatggtgaaaaaaattaggttgaaataagacatttcttgtttaaagattaaattaattattaattatatgaaaagtttataacaaaattagtatattttgagttgtgcagtacttctttcgttccaaaataaatataatcttaagttgttttatttttacaaataccaaaataaataataaataagcgaaagagaataataattttacaaaattaatattattattaatattacattgaaaagttaaaataaaacttatcaaagataataggaaaaaaataattaatattatacattagaaagttaacatgacactcgttaatttggggatatttttcacaaaggaagtacatatttgatactattaacattgatcgtatttgtaagaatactctgaaatggaatttgtagtataactcactttattacgagctggtgaatacttttatatactttttttcttttgcatatagaataatcaaatcgagatcagaacttataattttatgtatactacccgaactaccagtacctaagtgtaagaaaagtgaggagcataaatttggtataactttttttttaaaaaaaaaaattacatcctattgcaaattttctcattctgttgttttgcggtatctgtgaatcacttattgtctcaaacaatgtagaaggagttgaacactgaacccatgcatgtaaaacgtaaatatgtcacaagcataaaatattcgttaagacaagaggaataggtgcgctgtgcacatgtcccaaatctaaaagcttaaggataaacatcatattctaaaccaaatttaaacacaaaatcaaatcattcaccaccattaaaataaaataatcatttgtctctgatgctcttctgtggcctgatgcagcagctaaggtatgtagctggcccaattgttcctcaccacatgcatgtcttaattgggctctgtccttggagctaaattcaaattaatgattatacatttaggatcggttcaatacaatagaccaaaagtaaattaagatgaaattttttaattaaaataaaatataaaaatatgaattccatctccttttattatttatttcatttttttctttctcactgcaaacgaacgaaacctgatacaattggatgacatgctttgctagcataggacttttgatggaatgttaatgttatataattgctcgtctatggggaactaaaaactgggaccatttttgaaaacaacaaacctttactatacaatgggcttaaaagtagttacatatattcctgacgtaatgattcatcaaaaataaaaatttaaacaatggaaatggttagatatctctaaatagaatattgtccatacaaaatttcaaaagaattataattaaatttcatgcatattctgtgcagttaaccgtttattgttagaaaaaaaacttatttattagtctagttaaattagattttaataatctcatgcatattgtcctagctagctggtgccttgtttcaattttactttcattttttttactgaaaaaaaaatgaaaagtagctggtgtcttgtttcaattttacttttcatgagtgacacgagactcctatagatgctgcggaaatcctggttcaggattctttatctatcagataattttcatgttttgtttatttcattatgttttatgtacccaaaaaaaattaataatcggatgttaaatgattggttcgtttttcagtatcaattgacttgatgtttatttatgttattatttatttatttgttgttaattattgactaattttcatgataatagcaaaatgtccgtacataatttagagaaatttccagaaccagtccaacataatttagattaaagttttttttttcctttagggagtttttttttgtaaggtcaaactctatttttacatatatattttaataaaagaattaatttctatacattatcggtataatttttttatatggtcaatcagtcaaaaatactgtaattaaattttagaataattattataaaaacaaaaaatttataatacatgacaatttataatataaaaaattataatataaatgcattctaactaatatcttaataaaatatgtcttaaaacaaattaatctaaataaattgtcatgcatttccattccaaaccctattacctgtgccaaattaacgtgcatctttttctttcaattctaccgaacaaatgagaaaggaagttgtcgtgcttccatttattttcttctcttcttttaaatacgagcaatcatgtttatggttatgggtttcgatcatcatcaccatatatttttcagctataaaacatttcattccaactgttagatttgtttcctattatcaatattaatataatttctttttttttatttggtttatttaactactttgtacatgtgtcaaaaattgctcgttcttaatgtattattgttagtcgattaattgagcgatgtactatcgcaattaattaatgcaattataagataaattaggtttggagattctggagaatcaattataattcctatacattctattgattattgattaacaaattcattagggttcttgtgtttttcttcttgtcaaacatgatcattgggtgttagtaaatttaaaactggtagttcacaataagaagagacacgattgtgaaggaattaagttacatgtaaaacaataagctaggcttttcctaggttgaattgttagaaggagtgaaaggggaggttggcatgttccaaggtcacgcagtcaagacaagttacaagctacaagagcttattaattgtagtacttacaaatgacgtatcaaggaaggtttataaggagaaattgagcataagatctttatgttttcacaggtcgatctaatgaactgagccaaaccttattgcctaagagaaaagattaaagaacgagggaaaatgatacaaacagcagaagtattgaaaaaatgttaatataggaagtattttattgccttcataatgggatttgggattgttcaagatttggattgatatactggaatgttttactttgagtcatatatactagaaagaatgatcatacactggaatcttaaggttatgtttggataaaatttgtgaacataactttaagaatttcaatgtacattcttgaattctaaaacataaaatgaagatggaagaatttgtttttccgtaggaactaaactaaggtattagaagtttataacaatttacatataatgttgaatcaatttaactaaattccctcaatgaatttgttgttttgagaataaaagtatttttgaattctttaaattgacatccaaacatatatttcttaataagttgacaatgcagtgtccaaaatctgtgtttgaattagatcccctgctccgggatgttccagtggaacatccttagctggtagagcaaccttccacaactcattggggttgcccatatggccatgtaagcacacgcatgttatcttttctacaggaaaagtttggtctagttttttttttttttttaaaaaaaactaattcggtctaatttaaaaacttatttaaaggtttattttgtaataacattcataaataactcaaaaagctcacttttaaataaactaaaaaaataagcctttatgtaaattaacaaacgtcttaagacgaataaatatacaatttcaagaaattatagaaaaaatagtaataataacatacatcaatgataatatatttataataatctaaatatgtcaacttcttagatatagaaaacttttttaatagcccaaattaaataaatattttttttaaaataactatgatatactttatttagtaaataaccttaaatgatattaagtttagcttaacatgagtgaggtcatattcatcccctatcttattgtttatccacatctctaggtaagtagaacaattagatggatgtatttgatcaagggcttgaaaatccccaagatcgaattgtttccttgcaaaactatattaaggtgggtttgtattaaaggaggctttgaatcctaaagccatggagtggaccaatgagaaatgccatgattttcactctacaagttctaaatttagctccattatgctccctatgctttgaggttacttctgttggatgagaaatcgcagcttttcttttctccttcctatctatattaaaaagaaaaaagaaactttttttttacataaaaagaaatcctttgaaatatagagatgtgatttaaaacataaggtatactaacaataaaaaatcaatgattgaaactacgataaaatacacaaacataaataataaattatagttaaaattgtaactgttaattttcgtattaataattataaccacactctatctctaagaattcaccaccccttattttagaatagataaatatatttttaagaagaaaaaaaaaaaatcggtgacaatggcacctcatgcttataatcataaaacacaaacctcttatttttgggtctttaccgattcatcaatatatgtattaatcaattacatcaagcaacagcttagaataaaagaaacaaagaaggcatttgatttaaatatgcaaaggataatcacacatagcactagctgcagattacatattatacacaattaaaacctagacaaacaaacccaacaaaataataggattgaaggctaaattagtttcactatatgctacagctaaattatacatccatacagaaaagacaacatttgctggttgaagtcagtctaaaattatccttgggggaaggtgtacaccagcagcttgctcaggacacgtaaaaagttttacaatagaactagcagtgaggttgtaccttctctgtacttctgtaaatccttcacatagaacttcctccacccagttctccacctccctatcccggtctgaaacatattgagctgcaagaaattggtccatgacttctgtctggatctgcaatgcacactcggatccaagaattttgttgaagttacttctgatcactttcaacactctatccgcaagtgcttcaaaatcataaggtttaaaaacaactgtttcatcaaccagatcacacaaatcttgcaaccaaaggttttggttctcagttgagacatgatcagagtttccatcatttgtttgtttctgttcattctcttctgctgggagattcaaatctaacagccaatttgatgttgtatgtgcccttttagctgtatcagagagaaaatgcagatcatgaaatttatcgtcaccaatcaactttcgtttgtttaggatatttagattaggaaccgcatgtattgaattgttagttacactgatgctttggcttctgatgtctccaatcacatgttcaacttttatcttgatacctcccccttttgccctcagtattctttcctcagaatagttggaaggttcccctcttggcatcaaactattttggtaatctgagaaagaaaaaacaaacattgtattgtttacactaacttctcgtccatgtgagtctgaaatttttcctgtcttgatggctagagacaaactattttgagctagaatatctgccttttctacattttcaaggaaaaccacagacaggggtttcttgcaacactcccctacaataaaatcaagggcagtcttccctctgaatttcacatcgcatcctttcatttcttcagaacttagatccacaaaaataaagctttcacggctaccatacaatagctcagctagagaaacagcaattttctttttaccaagtctatcagatccaacaaaattcatccagatgtccccaggctgatttggtccacggtgtttaaccctctttgttgggctgcaaacaattgttttgatgatagcccgtaaagcttcatcttgccaggttacctccttggaaagaacttcaaaaagaattttgggattttttgcatcaacttgtccacaatagtcaaaacttaagcaggatgaagactgggatgaatgcttcaagatattcccatcagccaaattaaagttttgagaaaatcgacttgggatttcctttggaggctccattgtatattgaacagcgggtttcttcaatttattgctggtaggagaagagtatattcctaacccaagatctgtggttacagaagttacagatgtgggagacatttgactaccatcacacacacttgaattggacatgttgcatgatctttggtcacctgactcgtgatcttccactttctggaacatctcagcaagttttgaattatatttctcctgctttgccatgaaaactgcaggaaaaggactacttgattgtgatgtaggcatcatttgcatgccaacaggtacacgggagttgagattgatgtattcactaggtgatttgctgctgcaattgtcagtatcttcctttttcttttcagcaccacaatgaaaccccacaacagttggaaaagtaattgcatctcgctggtgcagatgctgggataacttgtcaaagttcttatgcagtgacccagattcactactatcgagcaaaacaccattatctttggtctgcactgaatgaaagaaaagtggtttttacacaaacaaaacaaaaaggactccatcgataaagtataaatcaactccagattatttacaatacaatcaacagaactaaagttacattcacaaatgatctgcaaggatgtcttgtaggaaatgctttccaattcgctgtttttgcattaattgctatttcatttattttattgattagtgtacctgttgtatttgcttctcctgaaggttggtcgaataacaaaaatgttgtattttccggtacatcattatggattggattagtgtttctcatgggtattcttaattctctcatttcttgaagctctatttattctagataaaaaacgaaatgacccctccccacaattctttcggattgtcaagcacattaaaaggttggtttttgaagtgctaacttatcaattaccaatacaaaacgagcaaatagaaaagattataatgcaatatggttacggttgctaatgcaagccatttgattttacaggtacaatcaatcagtaaacatatgacaacttgtttagtctcatttccggttcctgtgcaaaaaaagaattatcaattccctaaaaaggcaaggagcaacccaattaaaacatttgatcagtgaaatatttttaaaaaatttactcaccacaacagtagagcaaaatttgttattgtttatagtataacttgtcatattgcatctttgaaacaaaaaacaacagttcattttttgttgatcagctgttaagaccacacgtcccgacaaattaagagtcagcaaaagaagttttaaagcctttgaaacattagttttaagtacacgttactagactaaccagttactttaaacaaagaaaagcttgtaatttcaagaattgcacaagcttattctttactacaactgtgcacaagtattttttagcgggataaaggaaaaaactaccatcaaaatacacagtacaaataggtccatttccccaatcaagcttgttcataacttttttcgaaagtgttgctcataacttatgtccaccggccatagcatgaccttaaatctagtttgttttaattttctcctttttggggttggtaaatagccgcattcaattgaaaaattgctcaactttacagtctatacaaacaaatatataatataataataaattgaattgttgtatctgaatgctacacaccttaacattcaacccctttgttgagccaaattctgcaatctgcaaccacggaggcaagttagattgatgcggatcagcagctgaagaagcagaaaacctttccttggacgaagcaaggacttcatgttcacacctttccccaccacactggtgacagtggggaacacaataaaacgagccactcagtggagctttcaaatcagactgtgacgaaaagaagccaccaaacggtacaaatgaatccattaagctgtaaaacaaaaaattacagtttagacaaagatccagtgtccacttcgtcattcaaaaacaataaaatcaccataacataacactaacaccccttacttttagtacacaaaacccaaacccaactatgtgctttaaaatgtcagcaatgttaaaaacacttttttttgttacacataacagaaggaatatcttgtttgtcagactaatctctttcaaggaatctgaagacactcaaacgcgagttaccagctctcaaccagatttttttccatacacaagttaggattcaaaccctttaccagctacttgagatttgaatccatcataactcgaatgaaccacttgttagtgcatgttaaaaacacttaattcaaattaacaaggcttatcctacgaaaaataataaattaataaataaaaaagttaacacacttaaactcgaaggagataaaagatacatccagttgttgggaaaagggtgaaaggaaggaagaaagtttgcggattgaaatcctccaactaacatttctaacaacctaaaaaaaaaatattaaaaatttaaaaagtaataaacataagcacataaacgacaccaaagttcacgaaatggaattattataatatttaaaaagcgtgttttacctggacctgggacggtgataggattcggaaagaggcttaacagaggtaataggcagaagctgcaaatcccaatctttctctatagaaggaaacttccccacgaaattcaagtaattatcgtaactagcagcagcacccatcaaccaaaacttgtcataatgaacctgcaacaacttcgctaattctccaaccacacccctcaaactctgtccctcaccaccaccttcttcatcgtcgctcacaaaacccttcaagtccccgaaactcaccacaacaccgggccccacacactgctccgccaaattcccaatctccctcacgcgcctccccaccacctccgcgtccccactcgccacctcctccgcaatgcaaaccacgcgcagccccgacaattccaccggcagagccccttctctccgtttctccactgcctcggcaaagccacgcagagcgtcgctcgcacacgcgccgagaagcagcggattcttccccctgctccggaccagaacctccccgattcgccggaaattctctcctccgccgccgccgtcctcgtcaccaccgccgaaaaagaaggggaaccttcgcggcggctcggataagttgcagaggaaaatcggcgggccgcgggggcggagagggcggaggatggcgagcttaatatcggagcttcgaaaaccggcttcggcgaaaacgcgactcaccacggggtcgtccaggattgacaagatcaaatgctgaagctctactttgacagaagaaacagaaaacggttgctgctgagtttggtggtgagggtaaaagtggaagttatcggggtggcggcgttggttggcttgagagcgttttattgcggccatgagagagttcgagatgggagggtcgtggtcggaggaggcgtggttgtgagaggacggggcgcggtcgagggagacggagaggcagaggtcgagggccttgaactggaggcgtggggagtacgcgcagtttcgggcgcgggagcaggcgtcgcggaggagggggagggagaggagggcggagacggcgtggagcgacgtcgtttgggcgtggccgcggcggcgagcgacggagacggcctcgtcgagggcgcgggcggcgtcgggggttaggcattggcgcgcggctgccacgggcgtcggcatggggagtgaggctgaggggcgcgggtgggtggagtttccttattcaggaaaaacattaacggctgcctttttattttgggcaagtaagaaatttcgaaaaggagttttgtggggactcctaattttgcgttttgcttgcggcctctctataaataaacacactgcaacctgcttgcatctactataaattactacataacaaatttctcacttatattttgttctaaccgtatttaattaactaaagacttaattagttgttgattaagaaacaacaatttattcatttttcttcacaaatattttttacaattaattatattcaagatattatctgacgaggagtatggattccatacattttttgttatattcacgaggatatttagttactttttaatttttttattagttgaaaaatatgtttaattattcgataaataaattttttagtatcttattgtgtttttttaaaacattatttgaagtaatgttttttaaaatcttagtttttaatttttatatttttttattttattcattaatatatttattaaaatcctaattatccttttaaaataaatcataattttattattttttatttattttatatttttaactacagttaattttttcaaacatttaaaatttgataagttaatttttagttataaactagcttttcagcttttagcgagctgatctaattaaattataagtatttaaaaaaattatctattaaagttacataaatgataaaaataataattttttaccttaaatagaaaagattaaaaagaaaatttaataaatatttaagaacgaaaagtaaataaatataaaaattataagttaaaaattagtgttttgacaaacattagttcaattaacttttaaaaaaatattaaaaattattaaaagaattatttatcaaacatacaaataaacttttagactaataaaaaaattaaaatttaattaaaatattttaccaaacacactattaactttaaaatgaatgattagtatttttctatgtcccaatatcctaggtagagccatataatatcaacagtaaattacttcctatattttcaacacacttacatttttagcaactataaataaataaaattatctaattatgttagaataatctcttattatagtcaatttgtgttctcaatgatgacaagtgaatgtgatcaaaccgttcagttgggttaggttggattgcatgtgggaaaaaaaaattcttcaacaaatatgacatccaacttgaataatttaggtggtgttttgtttaaatattaattttttattttttgaaaatgatttttattttaaaaattttaagatttagaaaatatatatctaaaataaaatattctaagctcacattgtgtttttactttttcacaaaagcctgaaaatgttttcagaggaaatattttcaaaattttaaacaaacttattcttattcttattttctgttttatttaaaaataaaatagtaaacattcaaactaagtaccaccttgcataattcctttaagtatgattttctcctataaatatgacatccaaattgaataatttacatttatattgatgaagattttctttttatctacctttttatttttagtttcaaaattattagatcatatattatataatattattcaatagatgtagctcaagctcagtcgataacatacgttaaatatataagattataaaatattaatatatcttacatctttagaaaagaacaatcagtttaagtgtgtttaagtgtgatttagtcttgaacagttgattaatccatagtctatcaaaagggtcaaaatttgtgacaatatctcatggtcttatcaaaaattaaatgttctaattagagtgattaaaaaaatattatataataaattttaagaaatattatatagtattatcgttactattataccactacaaattatgttataatatataaaaatatattgtattataacagtattatataatgtaataaaataatacattagaatagtattaaacaatgtaatattttataattcattttttctacctattttttgtcttagtttattcgtctttttttttctttttgcctgtgaatgaattttttccacccattttcagtgtgtttcatgctttttcgaaaaattattttattcatttgaattatttttcccaaccatttattacttgttcgtataaggtttttggccaattattttgtctatttgcatacttttttttattcatgtgaatgattgttcctcttattttccctatctatttgcatggattttgccgtgcttatttaaatgagtttttcactaatccaaaaataataacatttttcactaatcctttcctctcatttacatggattttgttctctcaattatctaaacaaactcatatcatatatagcttccatatgtcatcacacgttaagatgagatcctcatgcagttccaatttccaaacattgataatgctggtaaacatattattcgtagatacatatataactcactttatactacttacaaactaagattttggggtataaattgcacagtaaaaatgcactaactcgtttactaatggatattggcaaaatataaaatatgatgcataatatggcgggacctaaagaagattgtgcaattcattgcatgttgagaaatgcgcacatatatattctctctatttcaattaatatgtatgtgtacactattatgtatgaattatgatgtatggtatagatcgaagagacgaggtgagatttttattggggcacatagttgagtgagatttttattgaatctctttgttttggtgtttttggaattgggtgagggtggagttgagtatcaaagtgtctgcgtcgtcgtcttcatcatgatcatgtttatggttgcttttcttttctgagagaaaaaaaaaaaaaaaagagagagatgctgcgtccacttactttctgtgggccaactaccacagtcatcctcattatctcattacgtcgtctgtgtaactctgatttttttttttattccttcaagtatagtttcattaagttttagtctttaaaaaaaaaacttattagtttttattattttctgaaataatatgtaccgctactaagtaattacgcgataaacattattattgagtaatctggcgagtttcccattcttaaattcaactcacttaaaactattccttgctatatatattaagagtggtgaataaatccatcatttaagcactgagatgcttttttttactgttgcccccactgacttaccatttgcgtttactgagagataatcacatttttttttggaagtgcatataattgattcaactcgcggtccaaaagatttttatttttttaatccagcagttaagtttattattacccactaatccaataccgaaagtcaaatcaacactttcataaaaaaatgtttgaagtaagataatgctttcttatttttatattaagaaaaattattattgtcccctaatttattcaaccagtaagcatgtttatttttttaaataagattttaaatttaaaaattatgtgtgaaagaattttcacaaaaaattaatcttatacatgttttttacttaaataaatttatttctataaaaaattacttatcatcccagataaaaattattacgtcaaattatcaattttagtaatgatttattatgagattttatatcgcttattaatttggtaaccttacattatattttaaattatgcaaacttgactacaaacacatagcaatccgtccgagaatctcccaaattatagataatagattattcatcgagtcaaatgttagccagcgttacactggtcagagatccaagtcaatgtgtaacttttgagagtggagagtaaagtaagagtgagatgggaaaataattattatgaccagtttattttgttttatttttaatttatgaaattatctttttttaatttgtttttggtataaatattagaaaataaaaatgtatttatttttgtagagacaaatatctccaattagagataattctaaataattttattcaactcaactaaaactactgtaaataataaagttattatttttaaattttgaataccattggatatttagaatttgaacatgaaactcccaattaaattaaattaatttttcgtcaattatgttttataaattaaaagtaaaaatagaaaaaattgtaataatacttactacaaaatgagttatgctaaaaaaacgatgttaacaattattaaataatactaattttctgaaaatcaagattaacaaagtagatttattaacaaaaatgttatcacacatttattaacatcagttgtcatgttaattgggcaatattaaatacatatttttaaaagtgtgtgatattcatataatcttttatagatttttattctgcaaaactatttgtattatttaatctatatttatttttgtcacgttgaagtaatgtataaagtattttaagaattaacgatatgaaaatatgagttgatgaataaaattaaaagaaaaggagaaagggtcaaaggtcccttcaacaagcatcattcatcactgcttttccacgtggcctgaagaagcatcccctatcagcatcaggttgcttttttacatttctttcccactttaggtaaaaaaagctatggatttgacgtccattttgttgttaccttgtgtgttcgctttgccaacgttttcaattacttttcttttcttttccttttttttaaatcactccaaataccaaacaccctctccaattttgggacctcccctccataatacaattatagtgatatgaacttgcttccacaaccctaccctgctggctgctgctacatattcttccattcctcactcctttttttatcatagtcctatctgggtttaaaattcccacctggtaatttagactatttaatgacaaaagtagcattacatcaatctctgttacctttttccttgttattaattattttgttttaattaatcttgttatgtttgtaattgaatttgagtagatgcattcacataataaatagtttttatacttctattcgattataaattatgatgtaagatacatttattgaattttttaataaatatcttaaaaaagatatcaagtgcatgattggtttcacatgcatacgtgtttttagataaatttttatatgtttaattttttgttaaaatatagattatagttatagaattgattttagattaataaaattttgaataaattttaggttgaatgaaaaaaaaattgttaaattttgctattaattttctttctagtggaaaaagactttgtatgtattaacaatttaatattattttatatttttattcaaccacaaattattatttttgataaatttattgacttttataaaattactttaaaaatatgcaaataataatacgtaatgtaataaacatatttcacagtcggtatatcactgtcaaattcttctttttaagtaaataaaaaattaaatataaatcatattacttcaaaattatttttgtaaaatgaatttgattcaaaattatgacaatgtgtgaaaattaaagtcattgaattttatggcaattgcttcatttaaaaataaaaataaaatgaagtagtattatcttattagctattaaggacgagtttagttaattaaagtatatgtaagtttgattggatgaattaattaaacacatgcaacacaaatctatcatgttgaatgtcgtttgtttttactttcgttttcctttttgcacatgtccactaaagattaattcagctggaggtgcatgcatgtttagagaactgcaaaataaatgggaacatacagctaataatgttcaaccagatgagggaaaccgcgatgggattgacagcaatcagatgaaatgttgagcgtgagagagaaagaagagcagcataggattcgtaggacagtgtttgataacgagagggagattgatttcagaaatgaagacaagccaaaagatccaagtgtcatgccacaaaataacaagttgagggggcacaatctcgcattaatggtttaccaacagatcatacaattttcttcttccaaccaataacatttcaaacatcaaattagtgataagtgtctctgctatttatcttccccagttaatcattttctcgttgagccagtctcgaaattgtgttattacttatcagagactgtatgtctcaccaagtcaaaacgttgtagtatgttgtggattgcttaattttaggcatcacaataaaaatcgactatgtaggtatcaattcgatcctattttaagtttgatggaaaaaaaaatctattttgacaagttttaccgagttggagaagcaaactttttgccccgctcccatacccgttcgttatatatatttttatattattaataacataattatatatttatatataattctattatatatattatgtgtaattgttaattatatagttatgtaatttcgtattttagttttttataattattaaaaatacaaaataattattttaatagctaaataaataattttataattgtaatactaattataaaaaaattaaaaataatgcatgtaactaaaaatataatttaactcttaaatatgtttatattatttattctttattaaattatatatatatatattgattgaattaaaatataattaataatttaatctataatttatttaaagtatatgaataaatattattatttaaaaatgtgagatgaattttttgagggttttctcgaatccaatagaattcgatgaagatgagattgaattttattttttcatcccacctttaataaatccaaaattaaacccactttaccttttagaaggatggagatgaagataagcaaacccactttcaacccatccctttgttatctctagttgctttaggctaagttgttggtaaagggtctataaaggtctatgcaaataattgtatggtagtaacatgaatagtcattttcacacatgacatcaatattgatatttaattttgtttgcagtcatgtacccacgtaaaatttggagctatttaggttattgataaagaatttcgttatttgaacaacaattatattatataagtacttttatcttccacttttattttttaattttttttcgtacacatgcatattaaaaatataattaaactaaatttaggagacatttttcattgtcactttttaatgtacacgaaatattttttcttgttaaaattaaaccttctaggtcttttgttattttgagtcaagttattgaaaaataaaaatagcaaaagctacatacaagtggtttcataatgatatatatatgaattgtcgttttcataaaagttattaatattgatatatcaattttatcattttcataattacatcttttttatactcccatgaaatagggaaatatggaaacgatcgagttacatatttttaggaaaaaaatgtttcatgtctatatagcatttttttgtgtgggaaagaatataatattttgttcctaattaatggaaaatgagttaaaatctcaaaagttggctttcactctacagcatggtcggcaactaatttccttgtcaactgaaatcttcccaaagaattagttacttttttttttatactaaaaataagacgatgcatctacctacaacatatgggtcagcaactgccccaactcctttaattttgagtgaaaatctatcaaaattgttcttcttttaataaataaaaatataggtgtgaggattaatagatatttgctactcaagtctatattgacattgactactcttcaaagtaaaagtaaatattggtgccctggcaagaagcacccactaaattcttttaataaagcaataaacccaataccctttttctcctgtaatttttttcatactaaatagcaagcccgtatttgaattttggaattttgtgtattagtaagtatattgtatgtccattgtcaaattgattagcccgtacaatcctacttttttttttttcaaacagtacaaacacacatgtagtgttaagttctttaatcataccaccactatactccaaaatgtttcatatccttgtttgtttttttatttttatttattttttatttcatacgaaaaggttagcttttaaaatgctaataaaagaatagagaacccaatgcttctacttgtttatttttttttatcttattagcaggacaataattagaaaatataattaactaaggctattgatcatcgatccctttctactttgctagtaaattcaatattcaataataagattaattaaatagactatcccacttcgaagaatatttctttaattcaaaagctagcctcttaatgaagttaacttctagtgcttaatattctaagtatgtttgactatttgctaattgataatttggcatcatgaagatcgacatgtgtccacttccaatatactttgcgttcaaagtataaaaattagttaaattaccatgagggttatcatttgattattatcatcacgtacgagattttttcttatccatgctagctatctactatcacaatcactattgtccactaacggggcactatattttctgccctggataaataaaaaggtcacaagctacgtgtatcaatttgcgtccacaaatacttttgctctgtttaatgatacatacacacatgacatggaaaaacaagctatattatagagtttcgtacaagcttcttggcactgtcattttcgtggcatctgaggggaccaaaaagacatacattctttgtcccaccgaatataactcgctgagattttctggggaaacaaacgatctgcataattttctgatgaagaaagttaaaaggaagagaatctgcagttggaagatctctcagctcacgaatctctaatgttgatggcttgcttttcacactaacactaaagttcgtgtgtgtttgtgatcaattaattaatgttgagttttaatcaatggagtatcagtttatatatatttatgacagcagcactaaactttaagaaaatatataccactgaattgtacaatcaatcagcatgacggcatctgtatatgatgcaaatgatagtacaatttatttattttatattaaaaatgatttctgattaactaatattataaagaacttttatactaatgtatttctattaaactatttttaataatgtcttaaagtttcaaaaacattttcgaccattcagtttgaatgattctttttagaaaataaactgagtattttaactatacatgttactgctacattggtttataaagatgttcaattatagcaaaggtagaatatttgttggatattttgagagtgtttaatttaaaagttctttttgatattttgaatttcatgcatatttctaattgcttttaatagagaatacattcgtccctgccaaaaaaaaaaatataagagtgtccagaattgaatcaaattgttttaagtcatcaacccaattaaaaaaacacaacaagaaatcaatcaattgacaatcgaaaaatccgaaaataaaaaaccatatttttattgtactttgtttcaggttttggttcctattattaaaaactaaaccaaacaaaattcctaggtcccacctttaacatacctatattatattgatttatagcattatcttcttgaagtatcttaaacttttgataatgataatttgtgattctatgtgtgttggatatgttggttaagttaaagtatgagttaacgacactaagagtatatgactagttggctataaataatttataatatattttcttataagagatttgtaatgaaatacataattttgggtgttcttttattattctattattttttaggagtaacttatgtaaatattgtttttaaaaagttaatatttactcaattcttgacgttaattatggagaagccatatgtatgtgacctatttcaagagtgagcataaatatctgtttaggatttcaattgttcatttgttctggagttttgaatgttaattatatgcttgtgttggtgagattcaatgttaaaatgtagttttcatccgtttgtttatccatttatatgcgtgtttattcactgtctcccttatgttttttaatcaaagcttctgcagaagtatcccacctgaaaggtaaaaagaatagtgcttgctaccagtaccagtatcctagttgtgcttgctaccggtgcttgtctaccttttcaacttaatcatattatagtatagctctagctagttttgcagtttattatttactgtagtctacccttttattgtaaagatttctacgttgaaaattttgtagtgaatgatacaaatataatgaatatatgatgaaacttagaaaaggcttgagatttattggacaaaatatagatgcagtttcacaaatatttttagtgttatttttttcaatcagaatgaaagtattttgataatatgcataataaaggtttaagttttcttttaaatgtcaacttgaattattgaggtgaaattttaattttgattgaaaaattgtattttaagttttgtctttttcttgaaaacacagtgcaatttatattgttattttcatttctgtgttcttctaagttctaaacccaatttcaaaggggagaatctgcaactgaaccaaatgattaaactaaaaaaacaagctagaaaagaaaagtaaagaaaaaaagagattgttttactagtcccctcctatgtagttgaaaccagtctgctgttccattcctaagttacttttcatataaagatgtgataatatttgactttcaccttcttgatggcccatggaccacttcttattagtggctagtgcgcatgaattgtattcttaagtcctttgtcccctttcttctattatgccttttcccagctgcactttctgctttatttttaatcaattccattccttttcgtatataagttttctccctgctgacatttattcttccatatgaaaaagttgtttgaatcctctatgatgtgtccttttttatttttatttttaatttgggtatctcttttacattaaattgaaaaattctttattcaccaaaagggaaggggggatgcataggtgtatacagatgttggatgtttactagggttatattagatactcatatggctgttcatcttaaaaaaagaaatccaaagtcagagttctaagccacttgtcaattgtcataacccaaaattcttccttcccaactgtaatattcgactatacttttctaaaagctataatcataacgcattttagcctttactccaatcctactttgttacttccacattgttaatggcaatcagttgaacctatatataaaccaccactaaagaagtgcttttttttttttccttcctaattttattttaatgtactatgaaagctatctatccgaattattccttttagaaaagtgaaaaaaattccaatataagattttgtatattttataatatttataaaaataactgttttatggccactttaatatggttacataaaaagtaaataaaacatttcgatacacgtttttctttttcttttttattatgattaattaatttgtataattattattttgacccgatttgaggaaatttcattataacgatcaagtgaccagcaaatttctttttgtgtccatatcagttacgtggagcgaatatttttctgcaaaaaaatgagtagctgcattccaaaagaataatacgtcagtgaatgatatgcagatttaatagaatcaaatgatataaataattgactatacatgctttataaaagaaatgaaagttgtatagtgattctactatgggttccttattaatttctgcatattgaaccaaagcatcaattgtatatatatgacaaattatatattattattttaaatcgacagaattaaaattttaaagaattgtaacactacttttatttagaaataaatgaaaatttcaagatgcataaaattatataaatatctaaatacacttatccgcacattttttcttcgtaattttttagttcagtaacttgatataaaatttccacagtaatatagtttaatttacagaactaaagcaaactagtttatgaaagatgttttttttttattggtgaaaaactaaaaactagattataaattatatataaaatacagtatacttattaagcaacgacaaagacagactttgacgtttcggccgcactaaggattttctatatattttgaacgtgatgtgctataggtttaccttttcgtggcaatacattcaccagaaagtggggtaggccacagatgcaaatggaagccactgttgctgcctcaattcaacaatcctaactgaacagaaagcaaagcagcttattatattaagtgtttgttcagttcatagttcattagacttgttacataaagtgtaactattttagttaatgttagtattccatacataaaagtaacagctttgattatcacctgttgaaaaatttaattaattgatctatttttagtagtgttttttttcataaaattcaaacagaagatcttatttaaaaaaaattgaattcgatttcacttaataatttgacgggtaatacatatatattcccaatttcaataatggcgtgtttgattattttattttaataacccctaattaaattgaattaaggatgcaatatttatagtcaatgttctactacattcatacgtgtcccctcacaaagaaagagagaaagaaattaaactaaaatctaatcgtcacacagaatcggaaatcttatcaacggaagcaattcgtaccaagaaaacattaatgttacaaaaagtgaagattggtctattctaaggccaacaaccatacaaaatgaaatcaaattgcttatgctaaatgaatccttgctgattgtaattgcaagggtggagttaaagtgaccacgaatatattcaaaaacactctcacttgaaggattgaataatctcactcactccttgagcaccatagcacaacatgcttgtcgcataaagggctagtgagataggactacactccttctctctcaaaattttaatttgcttttcctgaaaacatgttctgatatgcttcaaccatatcttgaaatgagatcattactttcttaggattaacagtgattcataatgaagggggttgatgccaaggcatgcaagtccaatatttagttttattttttttttgcaaaaagtggatcccctactggtgacatgaccctgaaatgagcaccaaaagaagttgaacaaggtgaagagagcaagacatgacaccaatatcaataatttgagaagggcaccagacaggggccacccccttcagcagaacaatcagcccacaatccgtacattattaagccttacagaagggggcctccaatacttgcataattgttgtgcaacacctatgtttactttgcagtccaatttttttttaaaaataagaatcttgatttatttgacaaaattacttttggttagtagaagtgaaaatcaaacattcatttaattagctagtagtatcttccatgcatgtttcttttgctcatgtaggatccaagtgtttatagtgctttttgtccccacagtgatcaccactttacaatataatcactaaagttgaacaacataaaaaaaaaattagtaggagagagagaatgttgttgcgtcccttctctttgtgaggattcctattctttggtatgtgtgggattgtgccccagtagaaggatgtgatccatgaactgtggaaaaagtttttctttatcaagtaaagaagaaaaatatgaatgggggataaaaggagaacgtcaaaaatataaattaaaaccactcttgcttttccttcatggcttaaatattttttttactataatacgtttcttttgtgtgtgtgggtcaaaagtttttttctttttcctttattttataattgaatttgttctctgtgtctttattagttgtaaggaagatcgtgttagaaatataagtaaggatttataaattttcatagagcttagttttaagatagtttttttaggtaagtccagttttttttttctgcaaaatcaattttaggcaagtcttaagatagttaaagctt

SEQ ID NO: 3 - DNA, 335913 bp, Glycine max; identical to SEQ ID NO: 2
  CDS (46798)..(48763),(48975)..(49573): Clone ID: 240O17_region_G3

SEQ ID NO: 4 - DNA, 513509 bp, Glycine max
  CDS (111805)..(113968),(114684)..(115204)
  unsure (1)..(513509): unsure at all n locations; Clone ID: 318O13_region_A3
aatccctctttagttagctagtaacatctcccttgttcttatatataatcatacttttcctctgtagatgtagcatcttcttagacctcattatcttgttaaacaactttgtgaaccaggttataatacttttctccccaaaacatttggaaacttctatagttatagatataaatgcaaccaaactattcatgtgccttccctaatagcttaagctttgagaatagtcagttgactcagttcataacagggaaatttttggtccaactactttaccattgtccatcctctctaatgtttcttttaccctaaactacagcttactaccaaaaataaataaataaataaataaaactgtaagtatagcataaccgcagacaaaatgctatagatagttaaatccaacactggacatgtgaaaatcacctaggggcttaaaacttcgtagtgttatcaagagttgctttcatatttctcatgacaatttgttagaaaatatgtaagatatatttagattatcttagaatatctttattgatatgttctacagttctagtgttattagttgcaggcttgggctaatactagtaggattactagtacctgacctaattagatataacaatgtttctcacaaccagtctctttcagtctgaaaacatcccacaccttgttccacccctgaatcttgggaaggtgtacaagaaaactcaagtgtagcaaactgacaggtaaagtaactgactaaagaattaggcaggatggaaataaaagctgattaaagaacccaaattttataccccagctaaatttgtaacataacagaagtaacgggaaaatactgacactaattaagcaaaaactttctcaaggaaaatattaaactcaaatgtaagagtaagtctaacacatacaatacttgctcaaacacaagagtttggttaacagtacctgtgtagagattatatgaagctttggacccatgaaactaaattgcagggaaggggaagcagtctttctacgctgatgcctgagaggcagctcgcaaaacataggtgcccattgccttggaatttgaaactccaaaaagtattgtaaatctccaggagaaggcttatctgcagagagtaagtgaatcaatggagtgttgtgcacctcaacagtaaagaaattaaacagtggctgttcaagtagtgatggcttggaaacttcatgtaaagaaaagcaaagcatacaagaacaatctaagagccaaaagccaaaaacatattggtttttttgggggggaaattcagttgacacccttcaacttcacactatatacggcttatgccttaaagttcaaaagacatacaagatggtccccagatttcctaacacatgtgaaatgttccatgattaacacatggcatctttggtcaggattttatggttgcatgacaggcatatgacatcttcgttaaattttggattgatgcatagatgcccatcaaaaggagcattatatgcacacattgggaagccaattgactatgttgcttgtttatgtttaaggactaaactgtggacataaagttgaagggtgtaaattgaactcttcaacatccctagtttttatttcggagcttatcttcatcatggtgaaaatatataaatagtaacagacaaaaaatggactaggataaatgtagaagattatcattgtttaatcagattaatcgtacagcgtagatacagattgattgcatgactaagatatccacttccaggaattcctgtcagaagtgaggaaataggaacaaacttgaagaggattgcttcagggttagacggcactgtctgaagccaatttgagtggctgtgcttgaacatatctcctcctctttttgagcaaataatagtgaggccctgttccaagataaagcaatatattcacaacctagaaaaattatttatttcaaatgaaaattatttccctttcagggcttacatccttgcttgatgtttctgaaatactagtgaactgcatcgtgtttgattgcatcacacggttaaagacctcagggacctacatcaatagagggattgcgtcagcagaaaagtaacaaataccttaaagttacaaaagatagcaatataccttttgtttgccatccgctgtcttcctctgtagtaaagaagggcttctcacatctgagaataaaaaatctccaagatcctccaaatgtcttctgagatcaccaggaggaatctttgaagaatgtttttgtttgacacagattaaatcttgacctcctacagccatacccactattatgtgtgtaccatatgtctggatgaacctgcctaacaaaattgattagcatcatatacttatcaacccaaaattatgcaccattcaaactatcaaaatcagttactgcatcaaacagtttcacccataaaacattcaaacatgaaaacatcaactaaaacaggcgctaaaagataattcaagtctcatgcgaaggtaagaagatattaaatcctttaatcaaccagttgatggctaccaattttgcagggatgatcaaaacgatgagagcacaaaaagccagcaacaaattgaatttatcaaaattcaacctcattggaagttatagaaagcgaaaagaagctattttaacatcaagaaaacaaagataccataatctgtgaatctagcaccaaagactgttgtatcagcttagtgtttacctagacaacgaagccggatcccaccgagccggaacagacttctttacctcctcttgcagtatgagtggagaagcagtgaggtgcaaatagtagagtgaaatgaaatacccatcaaaagcaaggtacttggtgtcagcagcatcacgaaaccaatccccactcaaatcaaagagcgcattaaaatagccagaaggaactttcccttgcactgctgatttctgattaagcaactcagacatctgcaacaatgattaaaacacagactttactaaaaacgcaccaaaacaacacagatcttcaatttaaaaaacgaaatcctccaaactaatctacagtaacagataaagaagaaggatgaggaaaaaagggacctgattgaattcaagtacatcagacttgaagcgtattctatcccctttatcacaacgaatattctcagaaacccctttaatggtaactcctccagttccaggaatcaaaatatccctcttgttctgttcatcaagcaccaccaacctctcttcacgaattccctttgcgaacctcaaccgaaaatcgctggccaaatcgaacccttttcccaaacactccaatgccaccatctcaacacccttttctgccgccatctccacaacgcaaaatcagttcagggattcaaaaaaaaaaaaaaaaaccagagagagagaaagtgaaaaaggtgttggctttggttaaggttacgacggtgccaaccaacaaaccaaccccaattgaaatgggttagctaagccatgtggggtgtgggccaaaacagaaaaggtgttggctttggtgtttttgctgaaatgggtatggtattgttagatgtggattgcaggttcggggaagaagatgggatcagtaaacgttacgcagcttttaatgagggaagagaagataaaaaaaaaagagtaacttggttaagtttggtttggaagaggagagaggaaatagctaatactaatagctatagctgctatgtaatgcaggtgtaacgggttgaatgtaactgttggagtttgactgtgtcagtggtattattgtgaaaatggcaaatatttttgtacaattgtgaaaatggcaatgggatggggaaagaataatattcatctgtgttttaaaagaatgggtaatcgctctgtcaactgaagattatgatgcgttttttttttgccgttactttagtctcttctctctcatcggactttacctactactatttcattcatttcatgatttcatcagttgctctccgataacaacaagattcaacggaagggaaaagggacccgtctcccatttttctagctcttcgtcctgtctggtcaaggacaacgggacacacatttgaaaaatggaactttttttttttctgtgccaacccggaaaatgagtcttatacaaatctatatcatgttcccaacgcaacagtaacgtaaatatttgaagtgaaactatactcttaaatcaaatgtactagtaactgtcacaaaatttaattcatatatatatatatatatatgcataataataatttctctcatgcataagttttattcttaattattttttttcataaattactttatgtttcactatatattttagaaaaaaatgatattaaaaaagttaaattctaaaataaaataagacttgctaaataaaaagattagggagtggttacattcaagtttcattatgcaagtatgacaagcaattctttactatacaactcttttttagcttcctgtttactctcttcaatcaatggctgtcgttggtgtttgtgagagactgttcatacatcattttcacttgtaaataagaatgtccaaatgaagaaagacgtgtttctttctgaagaaagcattgaccaaggaaaacggaacgaggagctggtatatatatatatatatatatactgagtgctgacaaggtaagtttttgtctactgatattacacatccacaaagaatattatctgtgattgtgggttaagatgggttttaaaacttgttcattatgaacttgttatttatataagtaattatttttttgcatacaaatttcatcttgatatgagttagagatgcgcttctccaattgcatcacctccttgttttgttgctacatcaaacctcgaaacttcaagcctgaacctgaacattatgagtgtgtgtttggtttgcaattacaaaccttcaaacttccgttcaactaaaaagcaacgaattcctatttttgtgctttgaaaagttaaaacattcatttgctttgatgcaaacgggttcgatctcaaacacaccctatattgtcaagacaagatattgaatataccctataacaaattacgcttaataatcaatagtcaagaggttgaaaactagttctatcctcttttggtaggtttgatctgttagctttttctaaagaatatataacattggaattgggttgagactttttgaaaaatttgaacttgttaaaaattccttcggctagattagtgagataagaccgattatgaacatctcataaaaagaatattggaaaaattaattacagcttgcaactttaatggaatctaaccaaccacatatgactaacatcactacacttggtgtgtttcactttcagtcttgtaatggttgttttcccactagtcaaattcataaaattcagatggctacgtaaaggggtttgtcgcagcaagagttgacgaatgatgaacatgcttcaaatggagttatatatatatatatatatatatatatatatatatatatatatatatggtcttgcacgaggtatgaggttgtcggtgttaaagcacagcacgtgcttgaaggagacagagggcatcaacagcatgcatacacgtgctggtcgtcgtcgcacaacttcaccgatcgagtctagacctcgaatgatttaaaatttgcaaggccacaccaaatagaataataaatattctataaattcacagaaccaccatcaacaacctcatcacacgtcttgttgcttgttctgttcttcctataatttgggagcgaagtggactttgccaacaaaggtctaagaactgtaattaaattaacaaaaaatttataaatagatattttaagtggctatccgtatgtttgggaggaacacaagaataagataaagaaaaataaaaacatagggaaatggaataaataaaaaaacatttaccatatataatacacatgtcaaattattagttgtattatttctatagaccacatatcgggacttttattaaaaagatgtaatttttttaaatttttccgggacaattttaaattattaccgaagatggattaagttgtaataggtggtgttacaaattgtaacatctatctattacacttattatctttttactttttttttaactaaaatcgtaataaaatttatgacttttatttaattttttttatttatagttttaaaattgtatatatttttttaatcttatgactttcaagttgttttttacctttaaatttttttattttagaaattttcatttatttttttcttttgttttgaattcaattttttttcaacaattataaataattttatttatttaattatttgaatattattttatttttggatattactttttaatatattttgtatctttaaaatttagataattttttaataatgttatttaatttcatttgttttgtaaatgaaataaaaactaacatgatgttatttaatatattttttaatatttgttttattttaaatacttaaatttaaaaaactaaatttttaaaacaaatattaaaatattttgttaaaaacattagtttatactttataaaataatattacttattttatataaaaaatgtactattaacaacatctaataatttaataataaaagtagttgttaaattaaaagtaacataatatattaatataaaataaatattacaaattaaagagaaagaagtgaataggtaatttagtccctgagattgtacccattttgcatattagtccctaacttaatattaaattcaaaatagtccctatcttcgcataagtgttgcaaaatagtcattccgttaaattttaaagtaacgccgttagtgaagtcaattttagtgccacgtggactatccaacgtggcactaaacgtggcactaaaggatgacgtggcatgacacgtggacgtgcctcttaaaatatgacacgtcatttgatgataacaaaacgagtaaataggcaatttaatccctgactttgtacccctattgcatattagtacctaccttaatgaaaaattcaaaatagtctctatcttttgcataagtattgcaaaatagtcattccgttaaattttaaagtaacattgttagtgaggtaattttagtgtcacgtcatttgatgatgatagaatgaatgacttcttcaaatttgatggttctgaatcaattgaggcatatatacgaaaaagacccacacacacttgcacaaataaaaagaaccaaaaatccacaacaacaaccttatctttgtaaccgtcaacaccaatgagcgaggtatgcataaccattctcttttcctcttttttttcttcaattaccattaatgtatcattccgggttttattttttttgtgtgtgttttgaataggaagagaaaaaaccagaggaaaacaaagtggaggagaaaaaaacagaggaagaagaaaagaaagaagaagagaaaaaactagaggaatcaaaagatgacaaggaatccaaggaggaatctgcgtcgccagaaatcatgcaaggcacaatctttgcaatgcatggacactttaagcatgatttctgacattttttaagttttggactattttgcaacacttatgcaaaagataaggactattttgaatttttcattaagttagggactaatatgcaacaggggtataaagtcagggactaaattgcttatttacttgttttgttatcatcaaatgacgtgacatcttttaggaggcacatccacgtgtcatgccatgtcatccttttgtgccacgttggatagtccacgtggcactaaaattgaccttactaacggcgttactttaaaatttaacggaaggactattttgtaacactcatgcaaagatatggactattttaaatttaacattaagttaaggactaatatgcaaaattggtacaatctcagggactaaattgtctattcactcaaagaaaaactaaattatatttaataaataaataaaattatttacaattataaaaaatgaaagcaaaacaaaagaaaataaaaataaaataaaaatctaaaagaaaaaacattaaaggttaaaataaaacttacaactttgaagtggtaagttaaaaaaaacttacaacttcaaagtcataccgtttttaaaatatatatatatacaactttgaaatcataaataaaaaaaaattaaattgaaatcatataaaattttacgacttcagttaagaaaaataaaaataacaagtcatagcacttattacgatttatctcattttcaataataaaaattgaaaaaaaatacatccttttggtaaaaattccccacatatcatggtggtggtgcacaagagattcacttcgtgagaaatagttttcatgtgaaattcatttaaaatgttattttctccaaaaagtgggagaatatttaggggagaggaatgtcgggtagttattttttcaatgattttaatgttgaatattttatataatataaaaacttaaaaatttcttaaaaaatattataataataaattacataaaaattattatttcagtaatttttattgaattaaaatttatcattaattaaatctaagggttcaaaaaaatttcggccgatataggaaccaatcaacttaagcatgcaagaaggcgttttataacatttagaaggataaataatttatcttagagtgtgtttagatagataattttaactgatgaaagtaatttatcagagaatttaaatttttttaatctaaaattcattgtttagatgttattttatgaaaaacttaaatttttgaaatttaaaacataattttaaacaaataagaatgcgaaattttaattttcttctaaaaggtgaaaaattgaaattttcttcttgatagaaaaaccctcaaaaaacgtttgtgtatttcatttataaccttcatactcacttcgatgatcctcttcttcaagaaacatcgtctgaggtcgcggagcatcgatcgagtgcaaacgtataatggtgtacatctcacggagcgttgatcgagtgcgaacgtataataatgtacatcgtcatgtttccctgtgacttcccatgccgcattaatattcttctctttaaaaacatatcaatcatatcgtatcttctcttttcattcattttctttcaccctcacaatttttattttttttatccaaatacaaaattttaaaaataaaagaatttcaattgaaatatttctgtcatccaagcacacttttagggaaaataagaaaaaaaaaacaaagaaaacgaaaagagcatggctttcccctgtaacagggctagactagacagcgtggatgtggtaaaattgattaacaagagtggtgaggaagggaggtgttataaaaagtgccaggaaggaggaagggaaatgttgtaaaaagtgccaagaagagcattaactatggtcaagtatgaattagcttctttcattatgatgaatattaagtcctcaaattagctgacgacacatcacagagaaataaacttcatcggaacaataacataaaatgggtgatattctattaatccaaagcatataataaatatccaagcctacaaaatagacaaaacgttaatcagtatccccgcattaatgtctcagtagctaagcgatgacgtattgatcagctagcatacagactttaagatacaaatacttcacacttaggacccatctggctgcataaaggggttggcgatctcatctgtaccatcagttggggacacaagcatcacagcagttcctctacaaacctgcattgcaataaaaataagtccccaggataatgaaatattcattgctaggccaaaataattcctgttgaaaaattatgatggaataattcaaaaaagctagtggaagaagtgcttatagtcatgtgaattttcaactttttgttttcttgcaggaaatgcttttatgttgtgataggttgatagaaattaaaatttgctgaatgctatcaactgagaaatcagggagcaaagctccttacaggctacagttgaggaaaaatcctctggtaatagaatactcaagaaaaggaaagaaatatgactgtcagtggtgtagtgcagccaacccccctctaagaccttcaccaatatttatcctcccccctctgtttccccttattttatactgattcctgagtccacactcccacagacccatgccaacagtcaccattcagttatagtttcctcctctctgtcttttctaaccgaaaattcccctttcggttattattcttgttcctctcataaaccagcaggtccttgctaccattgggcaaatcatattttcctatgctcttgtacatgtgttaagggcctatcataagtacatttactagaggcactgtacattttaaattttataaaatttaaacaatcagcatacacatctataaaccaaaaaaacaaaaacaaataatagagtaaaagtacaacttttcaccctcaatgaataatttaacatggccagaatcagtcaattgctttattatataagaactcttaatagaaaattaagaaaacatatttcaaattccttttcttgtagctcctttaacgcacttgatgaaatgttcttatttttttggaaggagatgacatgttcttaatagactccaccctattgtttaggttacaataagaacctataaaggattcaagagagaagataatggaaaatatatacatattagatgacagatgttgcttaagagttatataactgatatctcctatgtacttggactgtaattctaattaataacttgatatttttcttacaaatacaaaataaatattacatgagcttgatttattaaactgccctagaacctcacagaagcaaagatgcaaaattccaatgaagcacgacattaggaaaacaagctttttatgagccagaaggtgcaattctggcactcatttgatgttgaagaggagaacttacaattaagccaagatttctggtctggtcagtagttttgagaggatcatcaggatctgcagcacaagggacaaataaaatcttctttcaaacagcagaaaggaaatggtagataatttttaagaataagctaatatgttaatgttttgtggtggagtttataaacaagcatactgatagtaagtagagtcacacaaacatttgaactatgaaacaaaatcagctctttgacacatagaaggtacaataataagcatagttgcattgacatgccaagttcatctaagagtgtttaataatttgattctgcactatactgaacaaattctgaatggaaattccattttaaattcgaagctgaaacaaaaataagtaaaatgatgctgaattcaatcagcaaattaagaaaatgagtaaatcaagggattaatcaaagtgagaaaaaatttaaatatcataggatcttccactccaatgcttatgttatttggtactaaaagttcagtgctaaatctgcacttggggcgtattagggtaaacagcttgattaagcatttattcactaaactcttatcaaatgagaattctcataggcttggttacagagcttaatgaaataagctaaaaaaagcttattttgataaggttcatagttatgcttattgaataaactacaaatacaaaaggcatatagatagataataagctactttcataagcttaaacaagcccttcagaacgctcccttattgaaaaaaatggcattatttagctccttagtcgttactcattcaatctttcactctcagtcagtacaagtccctttatgtagttttttttaataatttgctaaatacccaaaattcgctgaaaaggctagaaaagcaccattatgaagtcacaaacatattaacaaagcaacagacaaagcaacagatacagctactgcagcacatataccattcaaacgataaacagaataacaagatctctatgttatttagttacctcttaaaaactctacagcttcatctaggacaaggttaagcaattgatcataccctttcagagtccctgtcactgcaatccaagaaaacaaaataaaataaaaaaatatacatgtagaagagtttatttgcattttaattatgaaagctaactcccaatcgagtacttgcaattcaaaacgaaacgaatttcatacttcctccatcattttaaacaatcaataaatcattaaccacatttaaaaaaaaattaagaaatcacaaaagaaggggattgggtaacctaaccttgtcttccaccagtaagcttaacttgaacgcctttgtctacaaactttgcaaggtccaaaaccgtttcttttctgcctgactgtgtcaattataaaatgcacaaaaaaaatagcagatcaaaaagagcattcaaaacaaaaacgtaaatgaaaaagggggcaaaaccctaaaagaagacagagagatgaaatagttttttgacattgaagatgcgattagggttcgctgaaacttaccatgcttaatcggcgtagtgaagggcttcctttagtgctgctttgtgtctgcgacaatgaagagagaagtaccgaagcgaatgtgatagtatactgtgtatttgaatatacagagagataccttagaagaagagaggagtgaagaagagctaatgggggcccaatatatatattgctgagaaaagtgacggcggaaataactttgaaacaaaatagaatcaaaaatgtattttaaaaaaatattacttattagagagattttaattataaattgtttttatttttttagaataattgttttaattatgtgtaaaaaataattttttaaatttttttaagtgaaactcatattaaaaaaattatgatcactcaacacataaatcaaactaagatgatctaacctaaacagaattatcaaaaaaagaattttatgttcagaataatgtcgttatgttccaattgaattatttctattactgaaacaagcaatgttgttttaatttttttgaagtgaaacttgtattaaaaaaattatgatcacctaacacataaatcaactaagataatctaacttaagtgaagttctcaaaaagagaatttcattgtccaaagtaaggtcattccgttaattatctctattacttaaacaaacaaaaaaacattaaaattttatgaaaataaattttaatcctctctatatttcatgaaaaagaaggtgaaaggaaatagagttaatttaaagctcaaaaatatagtagagaatccattttcattttttaaaagtattttacaatcttttaagaaaaatatgttcagaaggggtcataataacttagtaagtgtttttatacttgcattttaaaaaatacctaactctagagactcgtagtcgtatatatatcatttaactattgttaaatctgatgaatatttaaatattcatatacaaacttattgtatgcatcttaattactaaatagaaatgcattttaattaaaaaaaactttattatagatataacaaatatatttagttaaattcaaattcattatcataaaaaattaattacaaaatgtaaagtacattcactatcgaaaacaaaatagaataactgagttattacgttttttttaatttcaaatgtgactggttttttacaactataattataatttttgtcccatgtgatagtatttaccaactgttgggtttttttcaccattaaaattaataacttaaaaaatatcaaattaaaattaaaaagataaagaatcaagatgtatacaaaacataagaaatcaaattaaaactaaaggtaaacgactaattttatcttttattttttattctatcataaaggttcaattcaagctcaaactactttagtttcactaaaaatcataaaaagattttatagatgaatgaggggttgtatcattttataaaattaggttgtaatttatgaaaagatgtaaatatgaaaggtttttcatgaaagtgtgtgttctttcataaacataacaaaaatgtctatattattgaaaatatacaaatataattttttttaccaaaagtggaagtaattcttcataagtagttatgagatataattatttaaagattgtttatcttcatcaataggttataagattatatataaataaaaccaatccatacacaaatagtcccacacaaaaggagagttcattctttgtccacacaaatctaatggttattcgtagcggcggagcttggaacaaaaattggaggggccaagccaaaaaaaaaattcaccaaggggacaagctaattaaggttataatatttataaatagattaaatgtaataattttgataattaatatcactacttataagtgattttaaacctttgatgatatttttcaaatattaattattttctatgttaattgtgtgtttttttattgaggaggttgagcccaaaaattgtattttatgataataatttttttttcttatttaattaacatcacttgtcagaattttttttatttttttacacttttataccttcatctactattgaattaaaaaactgaaagaattatttgtaattttttttctgaaaaagaatattgctataaacattagttttatttattataaaaacaaaatatgtatgaaaatgcataaaaaattaaaaatttctatgaattttcaataaacttaaggaaatgattatatttttttatatcaaaattatagtaaaaattgtaaaaaaaatgtaaggaaataaaaaaaataatagcagaaatttgaaagaaaaatatcacaagttaaagtcatattgtataattatttaaatttaataataataataataataataataataataataataataataataattaaatattactcttctttatgtagttcaatgacataaaataattaggaatcaaaaaataattaactttaagaatattataaagatcttataagttactattaaaaatataaatagtttataagagagaaaaaaatgtatatgtgtataaaactttttcataaaagccccttggtcctttgaaaaagctccgccattggttgatcgtatacttgatcttctatgaatattgctttagagattcttgaatcaggcttcaattttcaagtggatcaagggcattttatgttacattattgatgatattcacattctggatgttaacctatctattcgagattggtgttagagtcatgtgtcaactgatgttcctatgtggcttaagcttgaggttgatgttgcttggggacatgttcttgatggtttttattcaaccacttctgcttacaaaaggctaacaaaatctattccttagtgtggccattccacctcccaaaaaatattaaacacttcatttggattgttgttctgtttcagatggaaaaacagtatttgtgaaaaccccgctcccgctgtcaaatttctattctcgtactggattaaccataaccctaacgtttgagtcatgcttctctactctgccttaagcttttcgattatggttgctcttcgaaagaagctaccatggctttgattaacaatttcacagaataatgtctgttgtagttgctttttatttttgacgtgttgaagactgtgcttttttctgtgttggtttgaaaggaaaacatggaccaatagaaaataggctttttttcttcattatataatctaaaccgttttttgagagtgaaagagagtcatttgtgaaggtgacggtgctttgtgccaaaaaggtgtagtggaggggaaccatggaaaatagagcttggaagcaaactcaaaatagcatgaatctgatctttttcatccctcttcttttattattaaagctgatgtggtttccatgccttttattccaatagctttttcaattcattttttttctctgttcagactcactttttgctattttttgtattttgccttttctctcctctacttaactcttgttttccttccatttttctcctatttactatattgattgtaagcataacatgacatgacatgttttgatatttatttctttttggttacattctcatgtcatgaatttcatttttaaaataaacaattcaattacaacgttttaaacgaattaatattttatcccctctttttctcaaggtgtacatactttgaggagtgtgaaaaaccatttttcttattaaaccaaccttggtagtttttcagaatttggattttttggtagtaattcatgataaaagcatagcacaagtcaaaaaaaccttctctcaaaaaaaagtccaaaaaagcttatcgcaacaatgaactaattgatgctaaatagacacattctgaatcatattgtcataattttctatcagaactttcgacagaaggacgtggcatacttattaactcttagatggataactagtcttggccatcattaaacaaacaactaaacaagtgctattcaattccatcaatttttttacaatttcttttttaactgtcaaatctctaactttcggagtggtgggggcttccggatcatagttgcttgctcaaaggaataagcaatttctatcagctttgactctgagcctttcaaacctccaaagcaaattccaaatggcacacccttttcataacctgctggaacaattactccaggataacctcctatagcaagtatagaactaaaggttgaagaaggtactaccaccgcatcaagttcatttgttatcattaatttctcaaatccattgtgggacaatctagacatatttaataccgcatgattaagttcctcaactccatttgtctcttcagctaacaacaagagatcttggccgtactcctcaagtttctcctgcaattttcatagaatcataccactcttaagttgctatatataattatctattttattttttaactatgaacaactaaatatatagaagtagctttttcacatactcaccaattctgggtgttccttgttgaaggctatcacatcggccaagcttctcactggggaattaaccaagtctctgaggtacgcgttcaaggataatttgaaatcatatgccatagcaatctcttcactttgaccatcaataatttcttcaatgttttctatctccaagttgtcaaccaaaactgctcccttttgcctgagtttgaaggaagtatatgagactgaatacaccaataagtaattaatactacaatttaatagtttaatacttaacagttgacacaaatattaattttcattaccttaatgttttgaagtgcagttctaaagttttgtgcataacagtatcgccactaaaaccgtagaaaaatctcacaacacctaatctctttcctctcagtccctctttctttagaaattgagcatagccaccttctgggacatattttgatgcttcaattgttgcctgatcattgatgtcgatgcctgcaatggtttcaagaacaagagcagcatctgatacagtcctgcaaattggtctgaaccggcccacatgatgttacacacttaatgcaataaaatgtagtattttgatagggaaagtaattatacttgcaaatttcaaacagctatgatataaagaaaatggcgcattaccatagacagatagacttacccaactgtgtcttgtcttggggtgattggaactacccctgctctactagtgagaccaaccgttggtttgatacccactactgagttaacgtttgaaggggataaaatggacccatcagtctcagtaccaagggacactgccaccaaatttgctgccaccgatattgctgatccgctactagatccacttggaccatccattgtgtatggattctgcacaacacaaatcacatattagtaagtagcaaccctttaattttttaagaatatggtttcaaccatacaaatctatgtataactttttagaatcattcaccccaaagtactgttttcacttttcagtcattttctataacctcatttatgtaacttagcagcttccaaatttacaagagaaatgttggtaatacatgtttttaacataccctttataaatctcatattttacattttagttcttacagttgcaatttttttaccctcatagtgcttgccctctgaagtcgcttaacaccatttgagatgaacttgtttgagatgaatgtagattaaataaatcacgtcactttcgtttcaacaacattagtctacatttgatggcgagaatcaaaaggtaaaaaactttcaactatggggactacaatggaatgctttaaactagagacactaaaaaaatgttgcaactatatggaacaagaaggtaattaaagctttatttatcgagcccatttataatttttacttatcaataaattttaaacaatagtaaagagcaaagagtatattaaaaagaatgtgttaaacatggtattttcaggtgacttctaagtagatagatttgacttgaaatgcaagaacaagctcagattaaagtaagaaaaagcaagtgaacgagtcaccttcccctgtccacctctggcactccaaccactgggtgctgcattggacctgtaaaatgcccactcactcatgctggccttgcctaaaatgatagccccagcttctcttaatctggaaactacacctgcatctctaggcaccacagagcccagaagagcaaaagagcctgcagtggtgttcatcttatccttggttgcaatgttgtccttaatcaaaatgggtattccatgcagtggtgaaagagaccccggtgccttagtctttctctcatggtcagctttatcagcttgtgatagtgcatctgggttcaactccaacacccctttcagaactgggttttgcgtttctatttgtttgaggtagaagtcaacgacttccctagaggttagttgttttgtccgaaaagcaagttggagatcataaacggttgcctcttcgattgagagtcctttggccttgttaataatggagaagagaaagtgaatagagggattaaaaaagaggacttcaaaaaaaaaagagagagagagagagaaacctcgtaccgtgtcggaagccatgaaaacaccacctcagccttcaggtacttcagtcttcagcagttatcttcctgcgattttcacgaaagagaaagtgaacagagggatcgaccatcatacgttttctactccaatcttatctcagtctgatccagcaccaagcatcgtagaattgtgcgatttcaggagttagatcgcaaatttaaaaacgacttcagtctcatatcagaaaatttagtcaacccactagtcataaatatgtcaaaaggttaattgaatactacattttaggcctaacaaacatgtgaccaatttattttaataaatataaatattaatttttgttaatattattatatgtattgaaaaatcattttaattccattatttagagtgtgttgaagtctgattaaagataatataattctaaaaaaatatataaataaggattaattcttatcttataaattagaattagaaatagttatatgttagttaatgggtgtctaccataataataaaataacaaatataatgatccgaagtgaataacttctcattcaaaaagtgacagtagaattttatttgtgactcaagtgtgaaagaaaatgataatatggctaagataattgtaataggtgagaaaagtatttaccattaagtgatgggaataatggttttttttagttagcaaattaaggatatatattgatattgtaggatacaaagggtatccaaacctatacaaataggaataatgataatagcacgcagtggataaatttcttaatcaaaagcacaaactatactagtatatagtcaatcaaacaactaatacaataaaacttattatattagagaactaaaaagatgaaaaattgaacaaaaaaaatagaacccttgtatgagtttacataatatctcacacaagcaatgaaccacaatctccacggttgaagttgaattagaaacccaacgtcaagaagtaattattcaaatttcaaccctgtctaatggttaagtaatttactaactcaattttactaagactgctttgtgtatgtgtgaatgagagtttttttttcctcttcagtcttctccactctccttaagttgctattttactttattaacattcaagtatttaaagtcccctcttaatttgtcccttccctactcgacaactaagagacataattggcttacaattttgagtctttctccatttagaagaggaagccgcacccaacataaaggctatgatgaagagcatgagaaactcacgaatttttggaggtagacgttaactttactgaaatttcacttgtaaagttggtattcgtggtccaagcgatggctagacatgcaggatcctactccctaatatcgtggacaagcagcaacattagatgcaataagaatcaaaaagaggaattattggagtgcatgtggtcctccggctttcctcgtatacattaaaatttagcttagacgtcttgagtttcagattaggaaatttggcttagcttaaacgcttttagatatgttaatgtcgtttcagcatatatgtatctattttaatatatatacatcattattttgatatgtctataaagattgaaataaatcaggtgattttaccaaggtgtatagcctataaaaacataaaacaagtctaaaaaacctctcagatagctaaatagacacacttcaaattttattgccatatatggtttttgtcagagttcctgatagaaggacatgacaatacttaatttactcttttagatggataattagtcttggccatcattaaacaaacaaacacttggctattcaattccatcaaaattctgacaatctttttgtaacggttaaacctccaactttcggagtggtgggggcttcctgatcaaagttgcttgctcaaaggaataagcaatttggatgagctttggttccgagcctttcaaacctccaaagataattccaaatggtgcacccttttcatatcccgctggaacagttactccaggataacctccccttgcaagtatactagcaaagaatgaaaaaggtaccaccattgcgtcaaggttatttgttatcattaatttctcaaatccaatatgtgacaatcttgccatgtttagcactgcttccttcagttccctaactccatttgtcttttgagctaccagcatgagatcttggccatactccttaagtttctcctgcaatttccatgccaatgttattatatttatattcgagtaaaatgagatttaggtgcttaatttttggttaaaattagtcttagtcaaataaaattcaaataataataaagaatgtgttaaaaagaacataatgttagtatttctatttgataattgatgaatttcgtcttccttatagaatttaaaatataaattttttgccctatctattttaaccatgaactactaaatagaagtggcttttttacatacataccaattttgggtgtttcttgttgaaggctatcacatcggccaagcttctcattggggaagcaactaagtctgaggtatgcgttcaaggataatttgaattcatatgccatagcaatgtcttcactttgatcattaagatttcctgaatgttgtttatctccaaattgtcaaccaaaactgctcctttttgcctgagtttgaaaaatatatgtatgagactaaataatgcagtaattaatacttgacacaaatagtaattttcattaccttagtgttttcaggtgcagtttgaaagtatcatgcttaaaagtgtcatttccaaaaccgtagaatgctctaacaacacctaatctctttcctctcagtccatctatctttagaaattgagcatagccatctcttggaacatactttgatgctttgattgttgccttatcattgatgtcgatgcctgcaatggtttcaagaacaagagcagcatctaatacagtcctgcaaattggtctgtaccagcccacaagatgttacacattaaatgcaacaagatgtattttgacgggaaaaataataatgcttgcaaattgcaaacagttttgatatcaagaaaatagcaaattacattaatacttcctaagacaaattacacaaaatactattctttgtttaatgtttataacaacttcccttatagttataggagtgctgttttcaatcattaagggaattagtgtaataataatatataaggaggatgtcagtataatgttttaaacattaaaggggttagtgtaagaatagaaaaaaaaagtgtatgtaattcgacaaaagctcagaagattcaagggtaatttgttcaaaagaaaatggtgacattaccattgacttacccaactgtgtcttgtaatggggtgattggaactacccctgctatactagtgaggccaactgttggtttaatgcccactactgagttagaacctgaagggcataaaatggacccatcagtctcactaccaagggaccctgccaccaaatttgcggccactgatattgctgatccactactagatccaccgggatcatcaatgtgtatggattctgcacaagtcaaatcacatactaagtttaatttttaagaatatgttttcaaccatacaaatctatatgtatatttcttttgggtgaatacttgggttgcctgggccggagtcagagactaggaagatccatttaagagagacttccctcaatagatttccttccatacatgcgagcctgagaatctaactactaaccatatgcttaattaaggaacatgactatctactaaccatattacactatgctgactcaacaattgaaacataaatataatagattactttattatgaactttgcaaatcataaaaaatagacatatatatgctatgagaaaaaaaattaaacagatagagttgagttgaaaagcaagaacaagcacagaataaagtgagaaaaacaagtaaatcaatcacctttctctgtccacctctgccattactcttctcttctctctccctaaagctgctgtataattacttgattaacccttcctcatatgccttagtttgacccttctcaactcgataaaatacatatgattggcttacaaatttgagcctttctccttttagaaaaggaaaccgcacccaacaaaaaagcaatgatgaagagcatgggaaacttaagaaattttggggggagacgttcactcacatatcttcggaattccgcttataaagttggtgtacgtggtccaaccaatggctacacagggtcactaatttcgtggacgagcagcaacatttaagcaataagaatccaaaaggaaattggcctctacatgctctatatgttctgtcagaatcttgatgaacggttgggcactattggagcgcatgtgggccttcggctttcctcgtatacatgaagccaagcaatggaatatacctttaattgtggcatatgatggaacagaacttttatacttttggttttatactatatttttaggttgatcttggcttctaatttctacaagtgtgaacaagaactcagatcattatactggataatgtttttggtataagtatgataaaattattatatgtgaattagttgtcaaaggagctttatcatataagcaaacactaacaaactttgcacatatgattaaatttagtttttctttgtatcagtcttgtcctagtagtatgcatagtttacttatggctgatgccataggtacttcttataccaggctgccatttttctttctatgttgttattttgttttccattgataaaaaaaatggccaaatattaattataataattatactctcttggttggatcaccattcaatcctagtaacttaatttctacacacattgggcttaaggtacgagaattgtgtacattttgagtcagatgacggttcaatccccataacataacttagtttccatagactttgtgtttgagggtcgatgattgtgtatcatccgatctcatatctcttatatggtccaatcgatatcaataccaatctgcctacaaccatgctcggaaatcttcgggagcgaggttccaacatcttgatatgtttaaccaccatcaaccctgaaaagttggacaaatcagctagcatacaaggtctttactgtgacctagaaagaaagtttaaacaatacatttcactcgaatgctctggacaaggtggcctccccgcaggaggaaacctatccagaatacattaatacataaactcaaagaaaattgtcacacaaaacaaagtaaatatgggggtgtgaatactgaatagtaaagcccatactccgaacctgccaaggcccaaccatgtcagtgctgggctcacttcacttgtcagaaacatatggccttcttcaaaccttgacaaatgagatggagaactaggttgaattagtgattagtgacggtgatgggtaattggtggttaggaagaacaacaagggttggttacagttaccgtagtgagtttctgatccgatggatgacgagcagcaagagggtccaagacaggagcaagaagaagagggttcacgacctcgaagtcacaaccgagaaatggaaaatagcctccaaaatcatctacttaatggagcttctcaagcaagagcccgaaatggtcattgccgttcgctccctggagcaccaccgcagacaaatcaacctccccaagccccaccgtgtctccgatttcctccgcaaaacgcccaacctcttcgaactctacaaggaccaaaagggggtgctatggtgcggcatgacctcaaaagccgagaacttgatggaacaacaacaaagggtcatcgaagaacatgccgacaaagtcgccgaacacgtcacgaggtttctcatgatgtcgctggataaaaggcttcccttggagaagattgctcatttcagaagagattttgggttgccgttggattttagagtccattgggtgcatatgtatcctcagcattttagggtggtgaaagcacttgatggggttgagtttttggagcttgtgtcttggaaccctgattgggcaatcactgagttagagaaaaaggtggtgacagagaaaactgcaactaccaataccccagggatgctttcaattccatttcctttgaagttccctgcgaattataagagggtgtatcgttactatggtgaaaagattcagcattttcaggagatgtcttatttgtctccctatgctgatgctcgtggacttaaggctggatcattggagtttgataaaagggctgttgctgttatgcatgaactgcttagtttcaccattgagaagaggttggtgactgatcacctcacacactttcgttgggagctggtgatgccccagaagctgatgaggcttctgctcaagcattgtgggatcttctatgtgtcagagagggggaagaggtttagtgtgttcttgactgaggcttatgagggttctgagctgattgagaaatgccccttggtgctgtggaaggagaaggttttggggcttgtggggtatagagggaggaagaagaagtttgaggtatgcagtgatgatggatctgatgtggaggatcatgatggtttggtttgtgatcagagggattctgaagtgggggacttgcatgtgcagattgagcctcggggtaccttggattatgaggatcctttacttggggatgattctgagatggatgttggagagattacatgaagatatggaaattgtttgaaagttgttgaggccggagttgtatttctgttttaccatatatatgattgattcaatttaaacttcaaagttctcaggaacatgcaattgtataaattgatgcaaatcaaattttgaggattgcattttactttcataggttagtaaatctcaatagcctgtatggtgctgatgtttcgaaaacctgttgcattttaaatgtggggaaatgtggctttttgacagatgaaaggttaaaagaaaatgaatcaacaataaaatcatactaaaattgggctacctcacagtcaaaacaaatgttcgtaaacaataaccaagatgtatcgtgggcgttaaaaacagagtcaaaacaaatgctcgtaaacataaccaacaataattgaattttctgtcaacttttatatttctactaaaattgctagtttgctgcatcatagttcatttttgtagctctttaattttaataacccgaagtcctaaatggtattgatacctcacagcagactaatgcaaaacttgtcacgactttgcaaatctttccaatattttttgctaaaattgctacctcacatagttcattttagaacccaagctcttagaaggattcgttaataatgtcaactacccaaagtcccaaggatattgattcctcgcaacagattataatgcaaaagttctccggtaggctaaattcaaaataggcttcggagtaaggaagagacaattgtgaggcaaatcatcatgtgaacacctagtggaataaggcttttgttgttgttgaacaaatcacatgaacaaaatgaacacaaactggaggattaatctatatgttgcatgtgtcataagcagagaaccatgattggtctgccaaatttgcaagttcactgtcctcttcgttacaaaacaactcaaattgaccattaacatttttcagcaccttggtgtcatcacaaataggcatgacaaggaggtcatccaaggtaggttgtatttcttcattaggcaaacgtgttttggcaagtagcttattatgtgtgctaatgtctttgtcatttttcttcttcaatttatcaatttgtttgtaggcctttgcagcttcctgctctgcatccatcgcccgcttctgcaagttaattcatcttatagaattagactcaagtaatgaactgagctgacccaactctttggaacacatctccaccaccagttaaactatatgcatgcaacagctgtaccaaaataaaattgacctgcttctgatggaataaacctgttaggataggtttacaatttgctaaaattcatttgagagtaaaagacttcaacataaaagaagaaaggtttaattatttcatttggcccctatagtttacaaactttaccttttattctctatacttaaaaatcatctcttttagttcttatgcatactatttttaatcttagtctctatcgtctaaattcatgaatgagaataagagaaacaatgggtgtattttataaggaacagattcttgctgatgaaactaggacaatattggagtaaagttggaagagagaaaggaggagggatgctgatgaaagcaataagtgtaggtgaaactattgaaaatatgcattgattcttgctcagctgaaatttgaatatccacattgattctttacatacctgtgcagtaatgacaccttcttctgcttcattaagtcgcacaagaagttcacctgcagcttgcactgcttcagcagtatccttcagttgagctcgaagacctctattttcatctcttaggattttcatttctttttctttttctgtttctgcttttaatgcagaaatttctgcagcaaggtcatttatgaatttagagtctgcacctctaaccccggctccggaagctgcttccttgacatcatcaattccatcctggatctttctatgcctttcaagcaattggatatgtttctcttctaaatcagcatactgttctaaagttcgtgtatgaccttctatagccatttgcattgttttattcagttcctcagcacacttcctctcagtatctagttcctgcttcctcttttcagctagtgacctgctagcttcaagttcagctctcagtttttcagttagagaaatccacctgctttctgcctcggtccattgacttttttcctgtttaatttttactttggcactgtcttcagtcgattctggatttgcatttgcctcagtgctagcctctgttaaatctgaaatggcagtgaggtttgctgccaaactaggttcagatgaataagtaaattgcaatggaggatattgctttcttgtggatttggatgaagagtcaacataaaagtgaagctgatttcttaaactacatatctcttccatcaacacttccctctccccaaattggtaaaaattctgatactcttgtaactcatcttgtactctttttaactctatcttcatcttcagaacttctaaatgatgctcatggttctcctttaaaagctgttgaattttgatagcaggcaagtcctatataaacatgaaagatagtaatcataaaaagaaaactttaaaataactcatttctaccttgttttcatgtgcaagggacaccggctcttcatccatgaactccttggtggataaaacaccatcaatatggctctgaaggcgtagaattttatcttctcttatctgtgctattgtggcattgcattccctctcttgcctgtacttttgcaactgcaaatatgattgaaaatagtcacaaaacaatgaccacagatgattctcagtatacagaaacttaccaagcaattgagctgcattatatcagaagtctgctttgcacagaactcttctagtgccatttctctccttatcgatcctgccaaaaccttctctgctgcctgcattataatagaaagaaatgaaaaataatagattgaatgtaagttataccagaaaatgcagctgagatcattgcaattactttaagaatttgcttctttggtttatcagttgactccgggcgatcaatcagtaccagctgcacatttgagctattggcaatctcattggcatcaagctgcattctgcttttacagttattacaggtaagcatagcataatcttcctttttggcattatcatcaagaaaagtctgggcgggaacatcaactttttccacaggaataattagcctggaatctttggatctcaatgagagattcgataacgatgcaccatgatggtggctatcaataatttcaagaccatggcagatgcttactgctaaattttccgttttagttaggaaatttggagctgtctggctagagagagctgcagacaaacatttctggttaacggtgtttgtacctaaatcactttcaccatgaatattattctcagaaggagactgctttaatgaggtcctcaaacttttcctgctgcttctgattgttggtgaaaggctggaaggacggaatttgaggatgggggatgttttgcatttaaccatgccgccagcagggctgtcaccattcattgcagcactaggagaaccaatagatccattaggggctgaaaaaccagcaaaacctccatttgagttgtggagaactacagcatgatcctcaacaccttcctcatcaatctccatctcctcatcaccatcttcatcaacatgaggtagtgataatgggtgattgagggtaggcttcaataaaatcaaacttcttctgatcaaagctgctgaatgaccccgacttccatcacttggactgtaaccattttctttaattcgatgcagttcatcctgtttgatttcttagttataagttatttgaaaaaaaaatatgtactggccaggtataaagaaatgattgatcatggtagaagagaaattaccctgagttggcatatcacgtctcgtaattgattcacatcatcgtgcattacttcattgacaactgctttattcttgatagcctttacacgttgtgcaaatctcaatgtactaagagtttcactcttacaactgcaatgttaagtcatgagaaataatccagcatacattaagagccagaagaagtcaaactcactaatggttgatatctaccttagtgctggggaaatagcacaaaccaatgctaattttgcatttccgccaagagactcctgcaataaaaatgtcaacctggagtctctatatggtatatgtcgcagctttcctgtctgagaaacttcagctagaatgtttatcaaattcctgcagtccaattcaacctcagtaagtaattgaatgatggatgagtagaatttcgcaatcaggaattttcagaccatggaattttcactgaactcatattgtcacaaaggattttaagtgtctgaaaagtgcagtgtaatttggtgagcaatgactgaatccatagaatctcagctgaagttcaggccaagctgctatagtcagctttggaactttccaccaaattttgcttctttgatcaccacaaaatgggtcatgtttggataatattctccataagtatttataggaaaaaaaaaagaaggtaaaatgcattgagcttcttcataagctaaaatcaacttatatttgtattcaaagctattcttcgtttgtgattgcttgtaatttgtatttgtatttcaattccgatatcaaacagcagtgtatacacatattttaaaccaaaaaattaagaaggtaaaatgcattgagcttcttcataagctaaaatcaacttatatttgtattcaaagctattcttcgtttgtgattgcttgtaatttgtatttgtatttcaattccgatatcaaacagcaatgaatacacacattttaaaccatacccaagctgtgaaagtgatctattaatattgccagcttcctttaaacggtctcctgctgcacccgttaatttttgtcgttctgacccagctagatcaacaagatttattttacttgttctaaatctgcttacaccatctgcagtactctgcaaagtgaaaatatgaactggcttcaatacctattttctctatttacaattctattgtgaagcaggaaaatatcatgccaacagaagttcttttggaaaacagaagaactgaaaagcaaaagttcaagattgctagatttccacatttcaatatagcacatgtagtttcttctaaaatttatctagttaaagattgtaaaatctctgcccttcctatctctacatacaacccataatacaaattctctaatattattaaaaactatattgttgaactgtctccaagccacaagagaagagtgcatcaccttgcatcgagattcaaccacacaagtaaaaacagtatgagagcgtgaactttcagaatttatactggttgcaccaattcttctgtttaacaaaccctgtgatgaaaggtatataatagtaaatacacaacgagagaaaaggataaaggaaaaccatggcaattatgaattttggagcccaaaaatgtctaaaaaaggaaaagaaagagggctattcaagtcagactgagagcaattaagcatttcatttttcttactactgattaaatcaaaatgaagctcggccaaatattcagtgtaatttcaaagatgacaacttccacatatttaagaacctgattttctaatgcattaataatatataattctaatcttttttctaatacttttgttgccattgagtgtgatggaagaaataaagacaaaatagtcgtagaaaaatagtttttggatcttactttactcctttaagaaaatctattttatatttctattggcttctagagtttactcataatggaatggttgagtagctaaccaaggcgataggcaacactgcaacagtgatgggagagggaaatcacaactgtctatacaaatgttatgaagcacacctttatcaaaagctgagccacatctttcttcgtacacacttgctcctctgtaagattttcaacatagacaccagatttgacatcttctctaatctgaataagcatcaaaagaccagttctagtataacccggttaagcatgattgagggaaaaccgtaacagaatagattttacctgtaggtttctttgatttggatctaatagatctgctatttgctcgttgtatatctgcaaaacaagttcacacatcaaaaggactagataacaagctcaagcagaggaattataaacatccattcaattctacctcgagaaaagagcagtggcactgatacttgagttgcttatcagaatgcttaatttgctcctgtgcatgaaacacaacaatgaaaatcacgacaaagttcatataaccatcaaaggattcaatcacgaatagaatagaactcgacacgtacctcatttatgagggaaaagagtctttcaaaaacacgaggcgcgaggccttgttgatcacttgctgaattgtcatctgacaaagcatcagcaggaccccacatggtataggtcttcccactcccagtctatccaattttttcaaaaatcaacgtaatcaatcaagagtaacggcacaatgcaatgcaaaatgggaagaaagtagaaacctgcccatatgcgaatacagaactattaaatccagccaagcaattctctacaagaggcgccccgacaagctcaaaaatatctaactggagaacaaaagagcaatccagtaagtaactaccacgaaatcatgagagagtcacagcgaacgagttcaatgtaataataaagtaattgtaaacttgaaatcgtgcctgagttgcattggagtgagcaacggaatcaaatgtgaagttttgaccgttgatggacaaggaatcactggaaatcctctgagctatggaatctccttcgtccccgtcactgcacgaaggcctcatcctcacaataacctagaaattagaatgtaaaatcataaattaattagttaaaaaaaaaaaaaaaagtaaaatctggaatggttgttgaccttgacgccggaattggatgcagcgggaacggaatggtcggaatgtttgcgcttgagagggttagggttgggagtggaagagggaggttttgggggaaggagggacttgaaaggaggaggattgttctctttgttcttggatttttgcttgcgcgtgggtctgggttttttgaaagcgtttgcggaaggagtgtcccggcaccggaagattggattttttggaagcatggttgcagttgcagagaacacgacggagcacagaagagaacagaagagaaagtagggtttgggttgagagggggagggaggatgaagaaagtagccgttaggggagttgggaaatggaagggatttgaatgtcagcacgtgtacggttcttgtgtgtacgtgagaaaataaatttactttctatatttaacttgtgatttttctgagagaaaattttattagtctctaaaataaaatgactttacactatctaatcactgttaaatacttttaaaaaaatattctttctaataatttttttagtgtttattcttcttatttttattgatactttaaaaaattattctttctaataaaaaaatttagtgtttattcttcttatttttattgggagaaaaagagaggtaatgtctctctcttcatcttttttttaaaaaaataaataaaaatcaaacaaaagtgagaaagagtaagatcaaaggatactaagaaagtcatctagtttaattaactaacttattataaaacttttaatatttatatttaattcttacggataaaaaatataaaaaaagatggtgatttaaagatgagaaaaacatgatgtaattattatattttttatattcaaatgtgaaatattatacttattaaaaaatattttaaaaattaaataatatatacataaaatacataatattaaaataatatatgtattataatttgattttattttgttcaatttaaaaaacatacaaatcggcagactgaactaaattaattgattcaagagaaaaaattttcaaacaaatgacataaaaatcagtttggtttaatttttattttttttgaagtaattttttatttttattattttatatcaatttaaatttaaacacccttcacactactaactcatcactgctctctcagttcctttatattatatgctataataaattttaggttaaattatttatttaattcttataatttcgtgatttttatttttttagtatatataattttaaaatgatttttttaatctctataattaatattttaattctcttataattttgataatgatgtttttagtctacattttaattttccgaatattatgtaaggagcgaagtttagaagctgcttggaacgaagccacggcttcaccaccacaacggattcgaatattctagaatctccgccatcgccgccctgcgtggccgaaatcttcatgtagtacttgatcccagacaccacttgcgactgcgcctccaccacttcctcgaacgtcacttcctcctcctccttctgcgcctgcctcagcatccggttatgctcctccaccgagaaccgccctagatcctgcaccaccgccatcgctcaattgagattgatttagaacaatggagttacgtatacggtgtcgtttatataaagggggaaaggaagaagaggtgtttggacatgcatgaaaaactaaacgagagacagtggaattggatggtggggaatggaaaaccgcgtgcgtgtggcgattgggatggaaacgggattatgccttttctttttgagatttagtttgtttaatcgggttgtgatggtgatatgatgtaaagagggtaatgcgatgcaacagtagggtaggagtggtgccacggcatgcgtaatgggtaatagtagttggcttcgtgtgcttgcaagaaactcacacatggcttcgcactgatctcagaatgttttaaaccaagaggaagaaagaacgtagacggagaacccaaaaggaatcttattggatgagacaggaaatgtgataggggatgaggcagctgattttgatcccatttagctcacaaatcatctagagttccaagtcttttaggtttaatattaagaccttgctttttcaattttaataatttataaaataattatatatttaataatatttcaaaaattatttatttatcggtagactatgcgattagtaattagaacgtttttgtttaatattaatatattacttaatataaaatattttttaaaaaatatcatttaatcattatctaatcaatcatagtttaaccatcaaatcttaaattaatatttttacccattcccttattggtttttttttttttgtactagttgtttaacttattgggtaagataagaaactaattatatttgcatgtgactatcattaactaaaaaaaaatttacataaaaaataattaaatacaaaacattctcctattagataaatgattttctacatgtaaacacaagatgattctccacaaagtgaatgcaatttcatatcacctgtgaatcttataagttgatttgatttagttattggtctaactctaaaaatagtaaaaagattatataaaatttaaattttataccttacattcatttttagcgtaatgctttactgcatttataacttaaataaactatattatgaaaaaacagaaataaaaataaaaataccacatatattaattttcccataattagaattttgtactgttgtaatttttgataaacatatctttccttttgattaaaccaaagtcctatatccaaattctgaagataagagtaagtggttgttggagctggcagagtctaatcacacgcagtgactccattcctccaaaatggagtgtttgaaatcccccttcctcttctccacttcacttctccctccaccttctcatcaaccctactccattacgccaaacataaagaacaagaagaataagaaacctcgagttcccatcttcattcgctgcaccatccagcgcgacccgtggtccccgacttccggcgaccccacccgacccaagcctcggagtcggaacccgaagaagccgctgtccgacgacaacgcgaggcgcatcataaagggaaaggcggcgtaccagagcatcctgcggcggaaccagggcccgcaggctcagaccccgaggtggattaagaggacccccgagcagatggtgcggtacctgcaggatgaccgcaacggccaattgtacggcagacacgtcctcgccgcggttaagaaagtgcgctctctctctcagagagtcgacggcgactacgacatgaggatggtgatggcttcgtttgtgggcaagctcagcttcaaggagatgtgcgttgtgctcaaggagcagaaggggtggaggcaagtcagagacttctttgcttggatgaaattgcaggttcacttcctctctctctctctctccttacttcaatcttgtgttgcgtagaatatggtttggtttataaaaattgtttgcatcgtttcctgtagttggaattagataaatagttaatgagtttggtttgtttggataaacttatctgaaagcacttttagaaatagccagctgcagtcatgaaggaggagtgcatcccaattatgttggcacccactacctctaccatcctcagctggctaaaattatattcatgaaccaaagagaacaaaaaaaaaaaaaaacgatatgggggactataccaaaacccatggaagaagctgatatctgaaagcatttagtattagaagaaaatagaaggaaatttagaattgagtttttttcttaagctaaaatcaccgtatgctcttaagttttttgagaacttagatgagagagcttctataaaagttaagtgcatacattgattttagctcacgagataagtttaattcattttacatttttttttatttttcttttcctataaaggcttatgagcttatggggaagtttattcaaacagggtgcataaattgattttaatttattgaagaagctcaattcattttaccttcttattttcttctctaaagtacttatggataagtttattcaaactgggcctttatggttaacatcacatagacagtgatcggttaatacttaatagtgtatgctacctatcattagtgatagggtgtgtgacactatttcagaatgtttgccctgctttgttagttttatgcatcatagttgttgtggttttgtcactttgtgtctgtaaccaattatctataaaaaaaaacttcgtaccccattgtccggaggctcttcgctatgcgaaggtatgggggagggatgttgtaccagccttacccttgcatatgcaaagaggctgtttccggattcgaacccatgaccaacaagtcacaaaggcacaactttaccgctgcaccagggctcgccctcgtaaccaattatctatatacttggtttttcaatacagttttgaattttgactatttttgtgttccttttccaatacaaatatttgtaaacctagtgggtgtatatggcatgattatttcattttattttgatgttttgctccaaagtatagagattgatactgtgtattgatagtttggtgcctcaacagctgagctaccgtccaagtgtaattgtctacacaatagttttgcgcctatatgggcaagttggaaagctgaaactggctgaggagatcttcttggagatgcttgatgtaggttgtgagccagatgaagttgcttgtggtaccatgctttgttcgtatgccagatggggacgtcataaggctatgctgtctttttattctgctataaaagaaaggggaataattctttctgttgctgtcttcaactttatgatgtcttctttgcaaaagaaatcactccatagagaggttgtacatgtgtggaaggatatgctaggaaaaggggtgatacctaataattttacttatacagtggccatcagctcattcgtcaaagaagggctgcacgaagatgctttcaagacttttgatgagatgaggaattatggagttgttcctgaggagttaacttatagtctgcttataaatttaaatgctaaaagtggcaacagagatgaagtgcaaagactgtatgaggacatgaggtttcgaggaataattcccagtaattacacttgtgcttctcttctatctttgtattacaaatatgaggattaccctagagccctctcccttttttcagaaatggtacgcaataaaatttccactgatgaagtcatatatggtttgcttataagaatttatggaaagcttggtttatacgaggatgctcacaaaacatttgaagagacaaagaaccgagggcagctcaccagtgagaaaacatatttggcaatggcacaagtccatcttacttcaggaaatgtagacaaggccttggaagttattgaactcatgaagtctagcaatctatggttctctcgatttgcttatattgtgctgctgcagtgttatgtgatgaaagaagatgtagcatctgctgaaggaacatttctagctctctccaagacaggaccacctgatgctggctcctgtaatgatatgctcagtctgtacatgggacttaatttgacgaataaggccaaggagttcattgtccaaataagggagaatgagacaaattttgacaaggagctttatagaacagttatgaaggtttattgtaaggagggaatgctgccagaagctgagcagttgacaaatcagatggttaagactgaatattttaaaaatgacaaattcttcatgacattttattggattctttgtgaacataagggggatatggaatctgatgatgaacttgtggccattgagcccattgacaaatttaacgctacagctcttgggctgatgctcagtttatatctggcaaatggcaacttcaacaagacaaaaatattactgaaactgttgttgggttatgctgctgggggatcaaaaattgttagtcagctcatcatcaacttgtctaaagaaggtatccctctactataaaattgatcataccatatcttttgaaatttccattttcaacataaatttttcttttttcaggagaaatcagtaaagcagaattgcttaaccatcaattaactaagcttggctgcagaatggatgaagccactgtagcttctctaattagccattatggcaaacaacaaatgctgaaacaagctgaagatatttttgcagaatatataaattctcccacatctagtaaagtgctttataactctatgatcaatgcatatgccaaatgtggtaaacaagagaaagcatatttattatacaagcaagcaacaggggaaggacgtgatttgggtgctgttggaattagcatcgctgtaaattctttgaccaatggaggtatggccctggaaaagtaaagtaaactagagtctgatactctgatccatgtatcaacctgacacatgccagacaataattgttgtcttccactacacaatctataacttgtttgtttggaacgtgctatacatactgtagtggtttgcatagggtgagttttgaaaagaaaaaaaacactgatccccagtcttgctaaatttaaaagttttaattgtaaatatttaattgattatgttgtgctattcctacagtattccaattatttcaaaagtttaaggggatgctggcctcctattgcatttagtgaatgggaattatatttattttctaagatgtctattttgataacatagaattgtggaaaatcatgtaaatctgtcagtttcagaaaatgtcgaagtggcaggagcatcatctattccttgttgcttctcttttcagcatttagatatttagcatttggtagataattttatgcttaattctttttcaggaaaacatcaggaggcagagaatattgtccaaaggagtcttgaagaaaacttggagcttgacactgtggcttacaatacctttatcaaagccatgcttgaagcaggttgatatcaagcaccctgcatgcataggaaagataaaatgaaacaggaggctttcttatatggtttgttttgtgttgtaggcaaattgcattttgcatccagcatttttgagcacatgatttcctccggtgttgctccatcaattgaaacattcaacacaatgataaggttatagttttgataggctgtctttcactcatagaagttttcttatctacacttttggttactaatgttaaactgcctctgcagtgtctatggacaagaccaaaagttggatagagcagttgagatgttcaaccaagctagctcatgcagtgtccctttggatgaaaaaacatacatgaatttgattggctattatgggaaagctggtactgggtcttttttaccttaacctacttgaattctaataattatgaatgcaacattgtatctggctggatttcatgtgcatatttttttttcattaatatctaatatgaatatatgattcaatgtaaaatggagagtgcaaacgtaatgagattagcacttcgacgttatcaaatctgtatgatgattttttctcatgattggtatttcggaaatctgtgtgttgcaattttaattattttattttgtaggtttgatgcttgaagcatcacagctgttcagtaaaatgcaggaaggaggtataaaacccggaaaggtaaagttaaaatttttagccagattttcaagagtatagttggctattattataggtgtgattgaattactcttattcaaaaacttaagctgtactacaggcccaaaattctccagcacttgtccttttttatttcatgtttatgatcagtttgctcattaaactatatcttgctataagaaactccaattttagaatccatgtataaattatccaggtggtattcagatgcagggaatggctatttgcagttcattggttctgcaatattatgtttatgggcttcaagcattagactgcaaggaatattttatatattatgcttcatttagtttgtaattgttgaatattgtctatttcagtgctttagtgctaattctttgcctttgctggggaatgcaggtcagttataatatcatgatcaatgtatatgctaatgctggagttcttcatgaaacggagaaacttttccataccatgcagaggcaaggttatttgcctgattctttcacgtatctttcccttgtccaagcatatacgaggagcctgaattattctaaagccgaggaaaccatacatgctatgcaaagcaaaggcattccaccatcttgtgtccattttaatattttactccacgctttcataaaagctggattgattcatgaagccaagagggtttatgaggatctatcaacttttggtttagttcctgatcttgtatgtcatcgaacaatgctgaatggttacctgaaatgtggatatgtggaagaaggaatcaacttttttgaaagtatatgtgaatcaacaaaaagtgacaggttcattatgagtgcagctgtgcatttttacaaatctgctggaaagggaaggcaagctaaagaaatattaaatttaatgaacaacatggggatcccattcctcaagaaacttgaagttggatcaggagagagagtgaaaactccatgagatatgaccttcttcagaaatacttgggtacttaaaaggcattatgataatggacaaaaaaatggtatagaacatataagtctgatcaacccggtaatgacaatggtggatattgcatgtatgtttactggcaatgatgattggactcttagttcagaaggacttttgctggttataaggtggacctgatccacgtttgatgcaatgcagcctttcgccttttgactgcttttaacttcttctccaaccttcctttaaaacatgtaactcttgtcagatgaacttgaagatattatatactttaagcacaaagacttcccaagcattgtatattccttcaggtaaacctttgctataactgatgagttgacagtcctcaaagctcaacggtgtaaggtagccactactctggctttcaaaatttcagcggcagagaattttatggatgaagctcaacagaaggaagcaattttgaatgaacatgttatcaggttgaagaaagaaataaaagattgtgagtctgacttgccatctcttcaagatgataagaagaaatgcattgcagaaactatagggtacaaaaaaatgtgaggaaagacaaatctcaaatggtggaagatgatagataagttcggcaagaatttcagcacaaccgcatcgttgctagaaattcctcaacttgtttattttttcttcaaacagccaaatttattatgtttcggaggctactgtatgataagtttactcaaatattacgtagattaacacttaaaatggaagacttgaaactactatactgttgagtcttttattgttgttaatgtatgcttcaaaaatttctcgcagtttggtcttcttatttcacacagaaccgcttcatctcatatcatatgcgatgtgatcgcaaaagccaaaaggtatattacttctattgtagattagacggttgcattctcgttttgtagcagtactagaagaaggagccaataatttgtttacagactcggccttagagtggcgaaaagagcccatattatgtttttcaagctgcctcctaaattaactttgtcctacccactccactcatcaaacagattcaattttttattacttttgaaatacctattattatgtcccgaggaaaaatttaccgaggtctgcctcagttagttactatgaagattgtgatgagaatgattttgtaaaccacattttccttaaaaaggttgatgctttcaattagatttacaatgatacgtatctacgaggatttgttgattccattgtgatttctgaaaataaaatcagaagataaagggctcttcatactcaatcctttgtttaaaagagaaataaacataaactaaactgtaattgaaatctcggtgattcggggtatatacaaggaaacatcaaattgccaaaacttgctttacttcatttcttattagccatcagtgtacatagcttgaatgacaagacaactgacaaccgacaccatatgcattcttcatatgaaaatcacacaagatatgagcaaagctatttatgggaccaagacttgagacgacacaacaattggaatatcatactagtaagctatgcagagacagaggtagctctcaaatttaagcttcgctgtcaatagtcattggcacaggctcctgctttgctgttgctgttcttgcttgctctagtttattcatttttgcaaatatgctgctgtaaaattgtgcgtccttcttgttgtattctctcactttctgcttcaaaattttgtactccatctttacatccctgataaaatccatccaacagtggttaataaatacaaagaaattccatatatcagtgttgtctctttggaactaagtatattaactgtatattcaagttgaccacacttgagaacaaaagcatacctgttgtctggctcaatctcaagggctttcttaatatccatctcagctagatccaagtccacaagatggagatacccttgtgccctccgatagagtgcttttacatttctactatcaagctctaaaacctacgtgataaagcaaaactcggatgtcagcaattttcactctattcccttattgaattcagctaaggaaaaagaagaaacaaacttaggctgaagcacctttgtgcacatcttctctgcctgtttgtagtcctttagcttcaacttacaggctgcattgttgagattgcatgtgattttcaatgccttagtcttctgtttctcctcatcactgaaggaggaatcatactcaacaaactttatggcctgtcaccaaaagaaaaagaacaggtattgttagttcattctcaccacaacataactgtcagtaaccaagtaacataaataagatcttttggaatttataggaataccttttcatatctctttgaagctctttcatatttgccaaccttaaataaagcattcccttcttcctttttcttcccagctgcctcaatcttctcttgcgtattcagatcccacgattccttttcctgcatcccattttcagtaattaattttacatttcaaattagttcaaagtttaaaaacaaaaaaataaaaataagaagatgaaaacatgatagttctctcacctttataaaagaaagcagctcaacttcatagtacacagtagaattaggaggaacattagccaattcctgagaggatccagatggaccaaaagcatattcaggttgtatgatcagcaatgcaatttcccctttcttcatgctcttcacagcttggtcaagtccatcagtaacttgctctacatggttgatcaaacataacttagtaactagtaatagaaaaaagaagacttatgattcatgaagttaaaatgattgttaaaggtaccttcatcaattttgaactcgaatggctgttgatcatcgtagcccttcttaatgaagacagttccatcttgcagcttgccaatcagtttcactgaaacaaaggaaacaatggaactcttcaacatcccatccaatatatacaaaatatttaaatgaaggaagagaagggtttgaaaagattatattaaaactgtaccttgaactacagctccatcatttggtcgttcatatccctccccttccttcaaagtcttcttgagaacctttctatcgttggtaatgtcagacacagtcttccacgagaccaactcaagatccacttgaagagaagcatttggaggtacggcaccttcatctcctgaggctggccttccactctcaccaaatgcatctgcaaaactttgaatgtcaataaacttacacaagcaaaacgtgtagacataaatgttgctgataacaacagtcttactcacattgtggcttcacattcaagagaactttctctcccttcttcatggttttcacagccttggccaaagcaggacagaaataccctgcataaaaaagggggggaaaaagtcatattattgttacttgcgattagaatccagttacatggtaaggacaaaattcaaattttggaagcatgagactgaccctcttccacagtgaattccaccccatcagattttgaaatgactatcccatcttcaagcctagcttcatacttaactgcagagaagagaaaaagaaggaaactttaaacaatactgaaagtgttgctaaacagaagaatctcaaagacaataatggattgagtttcgtaccaaacacttcatccagatccttaggattatcccatttctccccttcagtaattatattcttcaaaattcctccatccttgcaaatgtccttcacacttgtccatgacagcaactccacatcaaactgcagagttgcattggggggaatagtgggaggagaacctgactctccataagccaattctgggggtattgtgaaaagggcattctcacctttcttcatggttttgataccttcatcccatcccttgatcacttgccctgcattagtcaagtcacaaaacattgaatactatagttattcatccattcatcattaatcacttaagtttaattttcatgtccagtataacaataaattaaataaccttcatcctgattacatttatgatttattatgtatgcacatataacattaacaattgtttttttaatcaatgaatgattgttttttatatacatacaataccagtaacaaaatttcaacttaatactatgtaaattactcaaacctccaatcactaaattgatcctaatcaatttttcagcaaagaacaatattacttatttcatcctgttaaatcttagtatctatcagcataaagaattttataatgtcattcaattaaaatcctctctataaaaaaatcaataattcacctctaaaaaaaaacaaaagtgaatcatgaatgaatgaatgtgtaccttggcctagcctgaacttgaaaggggtgcccctatcacggctagaatcaaatttggttccatcaagcaaggttccagtataatgcacttcaacttggtctccacagtcagggatgtcccaaccttcaccttcctttagcaacttcttcttcagccccattttcccaatctccttctcctccccaaccttcagaatcggactctcaatctcttcctcctctggcatttccatgttgccagcacttgggaactcgaaatcctcatccatggcttcccaacaagacaacaaatgtgtatgaaaaaagtaagtgctaagaactcagaaagaaatcacacgatcacaggagaatatggttttacgtttctgacacgatcaccggaaatggttttaggttattatgtatatacataggtaggagtgaaagaggagagtgtgtctagagagttctataatccaaagttgtcaagatggttccagatttatcatgttcgttccatttatttttttactatttattgtggtttatgaatatgatggtgatggtgatgatgatgaagttccaacatttagaaacaagatttttcaaatctaacgatccgacaatgaagcgattgttcgttattttacggatgggaatctaactgaacgttgaacagttctttccttttttattaatcctaaatatgtctcaggctgtctagctcgattgatccagagtatgtgtgacttattcttaataaatcctcacaatgttttcgactccaaccggtaaaaaaaaataaaaatcatacatatgtaattgtgttaaagattagataaattattttcaaactaacattattatcacttgaagagaatatatgtagtgtagaacgaatgaaaaaaaaatctatttttttcccttaacacgctttttttatttgttttttgcccgcaacttttttcccaatgatggtaccaaaaaaataattttaaaactattgcaatttctgttattaataatttgcttttagttaattttatttgtaatcttaattacggatgtgttattatatgcctacatatgcgttttgcagcaacatatctggactttcttttttaccggtagaaaaatttcacatgtttttaattaaactaagatataactttaatcttcttattttgttaattcactattttttatctaatttaaaattgagacgtttagttttcaggtttcgaaaatctctaattttagttcgatcttgaattttgtcttcatttaatattattattataagagaccaaaacacaaataatatatgtatttaaacctttattttatgatcaaaatatatgtttgcaaacctgggcacataatggaacacaatcctgataaaaaaaaaaaaaaaaagaagcaaagattattgatatttctgtcagagtcaaaacgaattttatataaactgaaaatgcatcattcaacaaattcataaaaacaaatgattgtataaagtacataatagggcaatgatagttgaacatccacaattattaaaaactaatacttattattcctctacttcctattccatcatatcacttataatacctatatttttctcccttttatcactttttaatattcatatctatcagaagaggaggagagtgtaatttgctctaaattttatcaagtcctcacaagtgataggcataaattgatcaatcaatgatctatcatccacaagttttattataacatgaaatgaaagttcagatagtcaaagaatcaattcaactacaatcacggtcaaatttcatcaaaatccttgtagccaatattctcgcagggaaaactattaggtcttcaaatacaatctagagaaccaaagaaacatatataaaaaaaaaaacttcgtaccccatttcaggtttcaactattaggtcttcactatgcgaaggtatgggggagggatgttgtacgcggccttacccttgcatatgcaaagaggctgtttccggattcgaacccatgaccaacaagtcaccaaggcacaactttaccgctgcaccaggactcgccctccgaagaaacatatatattgatgtaaataattgcagaaataaaatacccgcaaaattatttttgtccaaaaatacagaaaaaaaaaagaagaagaagaaatcacttctttttcttaagttgtttaacatttttggaattggcttgttctctggtcttgcgtttcctggtgagagcaaactctccaaacttatgacccacttttccctcagtgatcctacaacgaatagtggttttcccattgtaaatcttgacagtgctatcaacaaattctggcaagatagtcgatctccgtgaccaaatggtcttgttcaacaaaagatttggattcttcttcatcttatacaagaatgcatcaatgaacgccggtttgcgtgacaccagaggaggaggtgggggtggcttcttagcaacagtgtttgctgtatcgcctacaattccaagaaactgcttggttagagccctaagcatcattgtaggcctcattcttcctggtcaaacaaaaaaaatgcaaaccataatattaaactacagaatcaaaccattgtgaggtcatttacagatatactaaaggaaatggaatgcaatttttgcttcaattttgttttatccattcaaacataatggccattcgtagaggcttggggttattcttttttgtgctaaaatctatttttcctttccatataagaattaagtaaatagtcaaattagtccttcaatgataaagtttaggtcatattagttcctgaatgatagaaattatgattgaaggttcttgaatgggtatttcttaggtcaaatcagtcctcatatcacaaatctctgaattaatttgactgacagaacacatattgagagattaattcaaaataaaagcaaaataagctataaatacatatttggggaccatgaatataaatttcatcattatatattactgatgtatcttttaggcactaatttgattatttactctttcaaaataaataaaaatgtttcaaaataaaagcaatattaggttacttgtttatttcaacagaaaacaaactgagtaacaaattgacttttactttttggggtacagaaaggaggctccagagacctgacaatactcttgtagtgttgcagggcaccatttaaagtaagttaaactaagaaaactaaacgaaatgtggagaatggaaagtaactaagagaggtaaactgtatgatgtaaatcaaacaaaaataaaaaatatgttgttacagagggattgtacaaatttaatctgtgaaacaacttaatggcatacaagaaaaaaatacttcattcacatgaaaacaaaacactaacattccaatctccacgccttgaaagagcctaacccaatttgacaaactgaagtttgaaagcctaccctaaaaccatatcaatttgacatgacagtcttaatgaagaaaactgacagaacaagcctcgtatcagccccgagaaaagctccgcaacttaccaactaaaatccctcaccaatacattgaagatggaagcaatatacaacggggagttatacacatttcacataggtacactccctaacaagtaacaacccatcataaggacaaacaaattagagatataaagctccaaatctcagaccctcgaatgcacatgctaaacgcaaaaacaacagtgatggccacaagcccacaacaactagtagaaaattttcttaatctcaacacccaagcacttggtttttatggtattaatattagtaatacacacaaaaccacgaacacaatgagggaccaaattaggtcaccgaagcatatagtccacaacacagcgaaagccacttcatcaatttctacgaatttccttaaaaaaattcaaaactacattatcaggggtttgactcgtaacactttgtgactataaatggcatctacaataacgataaatgaatagttacagtgtatagagcatatcgcagatcacgaaatagaagaaatcgaaagaataaggacctgatcagaaaatggagaactggcaatgtgcggttgccggcgggaagaaccaacggcgtttagggtttgggctatgaagggaatggaaaggaaaggcagagtgaagcaaactggtgaatcgaacgcaagcttcactcatcattctgctaccagaatttagtttaaacaaattaagataaacaataataataataataataataataataataataataataataataataatttatatattaaattaaagaaaaaaataactgatgtgttaaaattgagaggaaaaaaagaatctaaactatgatccattacttcaaatcttcaatatgggttttaaacaaaaatatttttatttattaaaatagtttagtatatatttatgataaaaatattaagtttaattgtcatgtatttatcaatgtaaactttcagttctgttagaaattgttcccagtatgactacaagatggttattatgaaaataaaaaaaaatattatatatgaaaatttaaaatccatagtaaagaaatgtttttaaactataagttatattttttaatttataataaataattcacattgtgaaccttattttttctaatatcaataattgttttaaaaaaatgttgaaattcaatttaaaaattaagatgaaaaatataagaaattaagaaaaccaagtgaacaattacaaataaagataaatcataataatttgagatgatggaaaaataaatttttggggataatagttaaatcaaattaaaaaatatatatttaaaagtaataaaaaataaaatgtaaactaaaagcttaatataacaaattaggacaaggcatgtaactcaatgtgaatgataataattcttaaaattgcttccatgtaagaaaaactactaaaaacattataattgctagtgaaaatattcgtctaaattatacatgggtactcatttaattatccatctatttttttaaaaatattttatcatttaattaacaaataaatatttttaacacttctctagataaacaaaccattaattattaaaaatttccttttctttttaatttttttttatttatttttgaagtacataatatgttgtacttatttttttttattacttttgtttgaaaaaaaatgaaagttatgcatacatcttgtctgagttttttttttttttttacagctacatattgtatgagttaaaatactaatatcatgatatagttctttgagtaattaaaaacaaattacaaaaaagacagctgaaaaattgaacacactaaaaaaatatgaatatttttataggattacaaatatgttgtacttatttagtgtattattagtcatccttagtgttgatcctgtctttcaattgtcacccttattgtttatgtgtgattgttattgcaaacttactaaactattacttttttggttctaatattctttcctcctttaaacgctctaaatcactagtgtccaccgattatttttttttttcacaacctttactctactttttctcattagttggaacatctttgagatttttgaactcaagaatccttgttcatcaaatttattattatttttgttattattattcttgttcaagaattttctatgctagtggttgagttataggaaaaaaattctcaagaatccttattttaaaaaaaattgtacaagtaaaattcaaaaacccaaattagattttaccattagaataaaaaataaaaaaaaaagttattacattctatgtgacatcatgaaataataaaaagtgattcaagaacccaaaataaattattcccctaaagatattcttatgatctaagagaatctttaatagaaattattgaagtcaaaaatctctttcgaccagatttatcatcgttcgatcaagagttcttcatgtaatgttaggtttttagaaaataactttgaggaacttcattttttaaaaataatattattttttaatgtcatttgagagaaaaaaaaattttgatttttttttctatacaaataaaatccaagaaccccaaattaaattctacaaaaaaaaaattgtatctatataatataatgacactaaaaaaatgatccaataacccaaaaaatggattgttgcattaaaatgctctaaacttcgtgtttcttctctttcttttgttttagtgtcttggtgtgcggcttacataaagtatccttcctttcatttatttacttttaaataggttggtgcatgtaacttcctagaaaccgcgtaagaatatgtttattactgtaacaataaagtatcctcgttttcgcttggggtcgtgtatacccattttgtcttcatctccgttattactttgtaacaataactttttacatatttatttatctaattttaaatttaaaactaatttcagatattattaaattgaataattcataaaaatataatgtccatgaaatgtcaggtttcaattatgttcttaccaatttttaaacatttcaatatttcttttttatatttattagtaatgagtttctcatttattgtaaagatattcaattaagtaatttatgtttttaaaataaattcagtttcttccctttttgttccatcatatacaagtacttataactggttaatgtcatattattaattaactaattagtataatttaattagagtacaatatttatttaactattctaatcttatttgtatgtttaatatattcatgttatggataaaaattaagctacatacgttatcttcaatgtgtatttaactcatttatctgtaaaatagatttaaagtgcttcattttttgtcaactctgagatattgttagaaaaaatagattaaaaaaataaaaagactattattttataacaagaacaaaaagttgtactattattttggaacggaagagtatactaatagagactgtaccttcttgtttggctacgcaattaatttaggttcttgttctattttagagacacagcctgtgggggatatttgacatggattaaagctggcttagtagaaaatttggaaagctagctagttgcttactctgattccaatgccatttatttctttctgaataaagtttgtggtgatttccattcttgctataatttggtgatgtctattcataatattcaccaatatctcaagttgtgaaatcgtgattatagaaagaaaaaaaatcaagttgcctagtttggtgacgttgttcttaactttcctgtttacgccttaaggcagaatctgcttgtatttcttcttctttttttagatttttagttgcctattttttgattttctttttctttttagaatatattttgtggcttatgttaatatatttacttaaataataataataatactattacgtttgaataaaaaaccaccgaagaaaactttttcctttttatatttttcaacatatattacgttatatattaccaaataaacagataaatttttactctttcttaaaagtcaagctaattaattaactgaattcgttcataatttcgtagaagtaatactatataatgttatatacagtattgcattagatatatcttttgagaccaatgcacattattactgattctcttttttagaaattattttttattttaaccattataaactcaaatattttagttttaataaataattaagaataactgttccaaaacttaaaataatacgtaatctaaattaatataatccagttcaaataattcaacccataatattgatacagtcatttaagatttggttgcatccacactatgagaaaaataatatatttaactgaaaaattatgtttgatttttttcttgcacaaaattttgttagactaactaattatccatcaggagaaaattagtttcgcacccatgaaaaaaaaagaagtttaaataatatttttaattaaaaaataattataaaactattaaaccaatttgctcacatattaataccacaaaagcatgataaaattttaaaaatattaatttttttctcataaattttttttattaacataattcctataaaaataaaacttatttttgttcgtctttaatagtagtttttaataatagtttctcacgtgactaatggatttaatcattttatttttttattttttcaataacactaagaagagattataatttattattattttttttctcttaatctcattagaaaatactagaaaaccatccaaaaaataacaaaatattataatttaaagatttttagccataataaattatttaattcatttataatcaaattaaacatataagtcattattctttaacgtaattatcactaaagattaataaaaatatattttatttttgcatagactaaattaaaaaaattaatattttttaaattttataggtattttaaacatatttttaaaaaaatatttatatactttattttcatctttaattactgataaaagtcttaatatatgaaataagcatttaaattaaaattcagactgaccaacttttcaaaaaagtcgtactaaacgttaaaaatgacgtatatgacagacttgatttgacagctaacagattacattaaagccctttttgttttcaaaataaatcagctacttggcgtgaccggtgacccaatctattttttcaatttctgacccttaataatcaggcaacaaaaaagtaaaataaaaaatagtgttttaaaagaaaagaaaaaatcaaaagacaacaagtcaaatataggacgcattatgcaaaacgcggttctaacttctaaccgggcaagtagaagattctaagaaactgaaagtgggtgagaaaaagggaaaatgcaaagcaccagctatatatacgtaaatgccactctgattttttccacaacaaacaacaatctctctcctacctttctcgtgtctcttttattcttgtaacacaccttctcttttctcctagaaattctgagagggtgagtggtttttttgagttttgatagagagcaatagaatagctacatggggaagctcgtcgagattcttgaccaaggggtcaggattgctgcaaggtttcactctaattgcccccaaacgggccgcaagtactaccaccctccatccctctccgacaaccacggccaccactaccacgctggtgccaccaccaccagcgccggcggagtcaaagaggccgtggcggctaggagcattgacataattctttattctgtttgacagaaccatattttttttgtattttttgttcgattcgatcattgcgaggccattcatacatgtaattttgagctcaagttgataccaattttaaattttacaaacacttttctatgttatatggattgcttatttatacatgttgattttaattccgtatcaaaaacattagtcgaacgttcctaccagatctctatagatatgtagattttacgcgtatgaaaaaaatcaatgagaactttgttgactagatgtcttcaaggcatacaaaccctaatgtgggaggtattggttaggaaaaagatttcccataaactcatcaagttttttttttttttttttgggtttcctagagggctcctctttcagaaacacaacacacaattgaacactaaatgagaacaccttccccagcaaaaattcaaaccttagtaagtccctttcgctagactcaatcccattaccaaactcatcaagatttgaaccctagtaaaagatttcttattaaaattgaaacattttcgtacagaattgaatgataagcccaggttgtaaagggtcaacgttagattataattatatatataaaaaaaacattgttgcaatggttaaaatctgctgaaaattcagacaacttccttgttgataatgataggactatggtcgtctgcaaaaatagtcataactttctttgtttgacctgaaaagaactgcggctcttacaactccatgtctccatccaacataataaaagtagtaccatgttctccacaaggaaacagagaaaaaagagagagagagagagagagaagaaacaaacgatgcagagaagactataccgaaccaacttcaaaatggaggaaacatcagcagggcaaaaaaaaaaaaaactttaaagttgtgcctgaaactgtagtcatggactgattttcaaaaccttgggtaggagcatatatgaaaaagatacacattacttgattcaaacatgcgagaagatgattcactaaccagaaatgttctctagcaaatgaaacagaaggacacatttatgagttattctcatacatatttactgttgtttccgtggaaatggacaatttcaaaatgccaatgtaaagtaaacactttttgttgctaaaacagatacacttctattcaaatattaaatacatattagccaccattttgtcatttgataatggattgcagattcagaagtctagagcaaaatggagaaaactagggagaagaatatgttgtcatcagaaaaaaaaaccataagcaccaacatggtttgtggtccccaaattgcccaaggcttcttgtaaagaatattcagaaacagactttgaagatctatgcttccagataatgacccttgtatgctactaataattcctctgcattttctctgaaatgtggtatatacttgtccaagaacacctcctcagacaagcataacaaatgaatgtaactcgggaccttcttgcaaagttttttttctatcaagagctggaagactctatatcgaggaagcacgcgatcctccatgctatacattaaaacccttggctgatgaaccaggactgatttgggcagcataactgtatgcaagaagaattccagtccaaccttcaccttcttctctgatgttctaagcaaagttggggatcttctgaacatttgcaggccctcctcattggaaaaaccaaaacaaataattagcttcagttttctcctaaatgttttatagctcaaactacttattgaatggattgcatggacaagcattcttgaattttcattgaaacccatgtctacagcgcgcgaaacatagtctcctataatagactgccgtgtgatgaaaatacctggctgtagtttgagtagcattgcaagatgagacccaacaatgccacaactttccaagaagacaacattgtccataaattttttgtaatttgggagtatccggccacatctgagcaaaacatgaacaaaatctttctcactgcagagaattttcccaatagcttccacagaggggaccaatgttttcttcaaactgaaagtcaaaatggaggaattcttggaaatgaacttgcacaactccgagcgctcgagacccaacagctgaaagagctcaattttgggtctcaagattttgtcaacatcagtgaacagtatctggggtttgtgacgaatcaaaaagagaatctgggcttcagaaaacccaaattgtttgaaaaaactgagcacagacaaggggttttgggggaatctgctgcttgaaacacgttttgagatgtagaaggattgagttctcgagaaatcgaacttggcatttagataatcaataatggaagtgctttcctttgagtgttggcatgtggagaaagaagagagaaaggatctgacagagtgagaagagaaagagaagtgattggaaagggaaaataaaagagcagggtgtgacttgagggattgcattaacaaacaagacatcaaacactaaagaaggggttcttacttcttaggttgtctatttcggatttgcagctactaaagttgtctactttggttttgcagctaccattgttgagaatcagagactcactcacttcgctgctggtggcgtcgttcggtcgatggttgcggagttgggggattgggtttcaaccctacgcgccacggttgggcctggccccaagggtaccaactatctattcaaaaaggcccaacctaataaaattgattaatattactactataaaattgtgactagattatttcctacagcaaaaaaaaaataaaaatattatcgttattttagagaagaagaaaatatcactgttgatgattgtcagtgcacctccaacctattaacattcagaaaaatgcttttaataaacttttttttttttactgttgagagcattatttaaaatgctttaagataaaaaacaaacacattttatattttataatgactaaaataaataaaaaatatagataagaaaatgaaaaaaagttaaattgcaggaaaaaaatatatctgcgtcttttttttataactaaattggatgaaatttatagagctggttaaaaagggacatgaatttcaattaatagaaggaaaaaacgttactaaaaagtatgttaataccaagaggatctaatttgattggttaagtagaatatttgttaagcaagatatatgaattattataaatctttgtaaatatttttgattcttatgaataatgttaatgttgtcaacatattaattgaggttaagtataatggaatttataattttattaaatgtttgatcttcttaaaaaaaattgtcaccatgacattgactaaaaatgttcaccagatctccctaaaaaacctcactaatcattgttagtggagtttttatttataaatgattttcagcacacactcacgtgtaataaaaaaatgaattttaattataaatatattgcatatttagtgattaatataaattaaattttaatgtgctaacaatggtatccttattcattagcataatagatagtactttgaaaaactagaataattacaatatactgagcgcgcatgttcgatttcttgcaatgcactttgctccttttctactccttatatcttattctctttctttttataaggtctactactttccgtgacagaaataaaatacacaatctacttgacttaaaatcaaagacttgaaaaatgatatgtcaatgtaacatcacaaaattcgtcaagattcctccgtactgaattttaacatatcaacgttctaaaaatttgagaccaccaattaaataagaataaaacaaatcctccactaattgttctacatgcttatggttatgtgaacttttttcagagtcaatttattctcccgccttttacacctatttctgaaagcgaattcctccttcatgcacacatgcatgattgagtctactctatatacaggtattaatgagatccttaaagcagaatccctcaatcccatttctctcattagggcttctactattaaaggatttaacaagaatgaatcccaatgtaaaaggcagaaactgcaagttattatgagacttaatctaagacagagacaatatgccccgacccttgggaccaaaatttcaagaactaagaccggactaaaatataggtccaggccaaaataatgataggttactaagtatagtaaaaatgtatgattgcaaggatgaaataataactgaagatggtcaacatataaaaccaaactcctaggaggctaccaaaatgaacagaagacacatgatcaaaatatgcacctaaagacaaactaaaaacagaaaaatactgcaaatagcatgtcaataacaagaatccatcagagtggagagctgagtggaagcattatcagaacctagtaattttctaccttcaccgaggaccgactgacgtgcagcataccaattgtatccagtatggtctgctcttgactttccttttttctctcttgatgtctgcaggatatcttgctggagagttccattcttttgcagcctctcctttaaccacttgagccacaggggattcaggacccagaatggagttaacagttgtcaatccagaaccattcttctccagaactttaccactcttctgattcacagagttttccatttttggagatcttggcttgctactatgggcagcctcacctaagaggctcttcagaggagtgtgctccttactggtgctccagtttgtcaccttggcaattatttcttcattcttcttcctcccttgagactcgttgacaacctgcgtgagagtgggaaaccaagcagcctgtgaagtggaatctgtatgttgtgtgttctgccccttctggacttcagaagcagaagctttggggctaacctgactaggatcaaccaaggtcatgaaagatggtggttcaaacatttcagagtttccagactgctgtctgtcaggtgtagcttttgagttgttcaagcttgatttccctgttgatgccagcaagccagttgatggcaaagtttcagcatcagtaacagctggggcatcggattgcattgagagaactgtttaatggatcatgaaggaaaaattaaaaatcaattcgtttgctccaaaaaatcattaaagtattttagttttgttgctttatacaaataatgcgaggcaaggacaaaacaaaagagatggatcctcttccgggtttcctcttcacctttccacgaggaaaaacaatcctagaaagaatgagggagaaaaaactatatggatcacaccaaagcaacaggcaaatataaatttggtgaaaatcatagagagacaagatctaggcttgcatctttgtaagcatgaaaaaattattaccaatgaaattcattaggaaattttagcaccaggcaagattcagggatgcacaattgcacacaggtatagccagtatgtaatatcactaatatgtatgtgtctttagtgtgtataagttaatgcaaaaatatctcacccattctaatcaactaagaaaaaggagtaatattgcagtatagcacctagttctacagatacttctctttatcaagcactgcatcacattacctggtttcattgactaaccctagcatattaaaatggcctaactagagaatatatctaaacagtacaaatgttttctattaaaaacaacaaatgtatatatacctgaaacagaaccccagttcccttccaaactgtcacaccggctacctgagtcaactgaagcatcaactctggatgaaccaagtttacccaagttattaccagtttgatcttgaacaggcacagcattagacacttccctgtccggctgagcagaaggtacagtagttaaagatgtatattccctagcaaggtcttctgtagctttcactaatagtccagcatcttgagcttgacgggattcggtataagtatcaacagatttgttatattcttcatttagtttgatattaatattgatttcatcttcttttatgtctttctgggaacctggtagtggattaatatttctgcactctgtaccatttgacttgttcacaggtccatcatccacaatgtctaaagactctgaaatagctgggctttcaaaatgaccagtagcagattttggcaataaagcatcactcacagtaggcctttccatacattgagcatcaggaatatcacattgttcatttttacccatttcaccagcagcatcactcttaccagcgctgtcactcttaaataagtcatctgattgcttgacttcagattgcaagatgtcaccaggttgaagatctttcaatataatttcaatatcattttctaaattagattctacatccttgccatctaaagctacatcatttatttcagttattttttcctcatgatgacttgtgctgtctatgttaattgccctagttgtttcactagttgcagacctaaaggattcgtccctctgactctcattagaagaggccattaaactatcttctggtaaacttatctgctgggaatttttacacacatcatcaggtccatgctcttcagaaaagtgaaccatatgaatttcatttttctcagttttcatagctttcatagatgcatcagtctcatctgatctttgatgactttcaactgtgagctgggctggagaaacttcggtacactgttcagcatgcacttctttaggcgtaggctcactgtttaccagctccatcttcatgctattatctagaacatccatatctggagagaggatgtcacttttttcactcaattggtttgcattgaaatgaaatttattttcctcagtaacattgttctttaagtcatctcccttatatttcaatgactcggatgattgtaggaaaggattttggtataccactccttcaagatctttaaagtctccatactcactttgaggatgtgcttcatcagatatatcatcacacgtaggaagaagatcaacattaacatttccttctcccttttctggcaaaattttgtcatcactggaagtagcaaactgtaccacatatgcagagtctccctgtgcgtcatttgtgattacaaccgagtttaactcaagagggaggttatctgggggcaacaaagaaaggaactcagcaccattattttccttcagatgaacagctccatcacccacttcatgatccaaggaaactatatcacaaacggctattttagacacttcttcactcatttcacctacaactttatcagatgattccacaatttcaaccacatctctgtaggaattaatctcagcgccattattttccttcagatgaacagctccatcacccacttgatgatccaaggaaattgcatcactaacagctattttagacactccttcacatgtttcacctacaacattatcagatgattccacaatttcaatcacatctccagcagaattaatctcatccttttctttcaaattagtttcctttgcaacagatatcaaaatgcaatctgtcacattctcaacagcatggattttcttttctggcaatatatcaagcatggcttcagctttgccaggaagtgagtcacttaacaaaccaaaaaaaacatcactatccacattagttgatacttcggttctcaagtctgcaatggaacttgacaatggatccacagtagggcccgacaattgaccttgcaactccaccatgtttcccaattcaacactttcattttgaaaaatattaggattttgaatttggctgtcatcagttgacttgtcaattaactgacttgcatctgcagcgagaaacagataatcagacatgaaagaaccgtggagaagaaacaaagcacacagtaaaagggatataatatcagaaaaaatgcctattcaataatttttggaaaataaatatgtagttgtgtcatcatctgggcacagcaatacacttctgctatcctggatatttgcatcaatatccttccaaaagtttgaatatacaaaaactctcattttcttgtttctaacactcaaattacactcataaaaggttaaatttcactgaacaaaagaaagcaagacaaattgtgcacgtttagttggatccatgtcagtattgatgctcatcatgtagcagtcatgtgaacagatgcagatcacgatgcaaaattttgctttctagaactaagttgagcaatccaattaatgtaaatgaagtcaataaacagctttacagatttttttccaatcatcaagcttgatacctgtacgtcatgcaaaaccatatttacccttatttttaattacccaggccaaaatgttttgccgcacacaagtcgatactgagtgaaaaaagtaacaaggcaatttaataaaaggacatgtgatgtaaaacctatcttcccaccattgaaatctttgtcctcagaagagcctgaaaattttgtttcttttatgtcaaccctttccacatcagcacctgagtccaaactatcttgcaaccgttccttgatttctggaattgatccactatccgaaaagtctgcaactgcatccgagaacacctcatcttctgatctaattattttttctccatttccttcattgcccttctctttgttgcctgtctccaaggattttggacctgacacaaccaaacctcataaaatagatacaaatcagcaaacctgctgttttggaatgtagtactaattttaaagcctatacatatagaaaagtaattaaaattaatctcactaagtcaagatcaggtagaattacttcatttcctagtattcctcagcgtcaaagttagttagatttacttcatttcctagtatttctcagtattaaagtcaaaaccctacaaataagaaggaaattaacctggtgttttgtgatcatcatcagaaacatgttcgtcatctgagccattcaaatggggttgtccctcggaggcggacagtttgtaaccttcaatggttccacagatcttcttatgagcacgcctgtgcttggcactcggatgtggatttggaaatggccatccacatttgtgacacagatgaactccatgactctcgtgcccttcagcatcaaaatttccaaaataaaaattaaaaaaataagaccataaaaatcttcaccttgagaaacttgaaacacttgaaaagaaaaaacacagacacaacttccaaaaccagacaccccagaaagacaaaaacttttcataagaaaagcaccaaagtaacaaaataatataataacataataatggaatatggaaaggaaaagagagagaagaagaggaagaagaaaggggggaaaagaggatgagggcagtgaccctttaaagagaaaatgcaaaagaaaaagcacctgcagtgtgagttcttctttgatcctggttatccattgacaatgaaagagagtaagaaaatccaacaagtgaaaaacccagaggaagaagaagaatggagaggccagaaaaaccaaaactttagtggaatggaagcagaacagagggagggttggtgtatgtgtgtgtgttagagtaagataaacagagaagctgcagagaaagaagagggtaattacaatggaagtggactagtacactcctggtttggaagaacagcataaaaaacaaaagggcccgcacccatgtggacaacgtaagtcactcactgttcatgggaaacacgaaacttccgtttccatctctattctccgcttcaaacacttgtacactcgtacgtctaaaagggtattttagtcttctaacgtacaacactcagttccacatgcgctgcacgtgcctctgcccgtgacgacctttccaccgctgcggatagtgaaagggtcacatggctgtgacggtggggagaatgacggccaatgaggttagtggttggagtaaaatctttgtgatgtgtcgtgtcattggtacatgtaatgtagtgtagtgtgtacggtctatccatgtaagcgtccaaagccaaatgagaaagtatgtcccctgcgtacgtagcaaccccttctaatacttctattgctatttttttgtttttgtttgtatctgagaaacgatggttacgctgccattaggtttgggtttggtgtatttcattactatttctcacttctctgtatttattaaaaattgctattcttaattaggccatgggaggcttttattgtgagctcgtgcaaaattatactaacatggaagactatagtatagggtacgattatattcaccaaaatagaaaattttaggttgtccaaattgagatgtaacttaataaaaatggtataaactactaatgtgtttcatttatttcatcatttctcttctaagtttcaaacctaaccagagttgtcaccaccaatcaatgtaatttctactattttaaattggaataacactattcggcaagagaacacgttgatcttaaatgaaataaaacaataaaaaataattatgcaaaagtcaacaaacatatcaaattattgtaaaaaaattctgtttacttttttttaatacagaatcttttgtttactttatagcaatttgtgagaagcatcgaagatgggactagtatttcttaaccaaatttcttttaagttttaatgcattctaataatttaaacgtacaaaaataattataatagaataaaaatcaaaacttttgggacgtgggaccatccccaacatatgattgttgatgtacgcagattctgctgttggactactcaatcgtctcgctttcgaaccaacagtatatgtatggagtagttcagtttggattcatacacattacacagttcacaaatcattatcatgcttatttatctgtaaagatttttttaaaataaaaataacaatattaaataataaatcatgaaataaactgtcattgcaagtttaagatgaattaaattaattataaaggtcaacccaatattacaatatatcttgaaacacattaaaaacaaacaaacttaggtgtactgatcctaaatagaaaatattagtaataaaaaatactagtttattctcgttaaggatgcaatatattggtgcaccaagagtagtgtaaacttaaagagattccaagttattagaaatgggcggtgacggagacggccacaataatttggtgagttaagtggtgcaatggtagggccctcaacaagtgctgtgctgttggggatcttgtgggtagaatcatctttgcctaactgtccgatctaagaaattttatttaaggtggttagtgtcggagcgtgccttagaagacaataaagaagtactataatcacataacaacaaatattggtattttaattgcgttaaatgatcaaatgataaggggagagggacctttcacctttgtccttttactgccgagttaaatgtgcattgaaaattaaagaacacatataattagaatttataagtcttaaagctaactgtgaactttgataaattttacccatctctaaaaagagggagcatggatgggtcggattggtttatttatgttcttacacgatctgaaaatttgttataatcaatttcttgaagccgactctgtctttaatcccgttcaaaatctagtctttttgggacaaaattgagctacctatcattataacttatagatcttaacattgtgtatagttaaccgaaggatgaaaaaataataaaacttaagttaaaatatgttttacaatatataattcaaaacaaaaaatagcatgttataaaaaatactatcatttaaatcaaaatattactcatactatatatttgttagaaaaacatagactttcaaaaataatcttagaccttaaactttcgaatttgtcctcaaaatgcatcaaactatatttttaaaacgtgaaatccattcaaattaatttcttattgagctgggttagaggtcaagtttagtctttgctcattcctaaattatattatgtgtgattatatatacatttgagtcattgtaaattttttggtataagaactcaagtcttcctttgaataaaaaaaaaatgtgattgtaggaataacacatatattcatgaaggtggcatgtgtggagttgttttcatgtgatgcttatcatgcttcattgatgtgcataaagtgtatacaactttttatctttaggctttgggagtcgataaatgaatatttttagatcttaaagcgaatttatgtgtttagttgattgaaggacaagtcaaacttagttggttgtagcctcgtgagcttgttgattccttggtcttggtgaagctcaacctttgtccaacgactttgattgatcgagacatcaagttggatgattcatagtctctcaagcacaaagcttaaaatatatgagaatttgtcatattcacatgcattcaaacactcattgaccaactaggtctccaaaacaccgtgaagatgatcaagagagagttcgagtatgttagtgcctactaaataaaacaaggggacaatattttctatgggttgggttggggttgttctccataaagaggaattgttgtttggggtgggtgggatttaggtttatagggttatccttgttggtgggctatcctaaatgcatttttttcttctttttgatttagttatttttagtataaaaatattaatggatgatttttaaaccgtcaaagagtgtaaaagtgatgcatgtttatactttaacaaaattagttttaatttgaatacaatgacttaattgaaccaatttagaaatttatagatctaaattgaacaatttaaaaaatagaagataaaattgaactttaaaaataaattagagaatgaagatgataatttagcctaaaagtataaaaaagaaaaggaaatatatttagcaattgtggagatataaatagccattgccgttcctattttcgttttgctccataagaatatagatatagaatccctaaatggctgttgggtcatcaatttagccagctagcccaaaaccatttgcaacatacaacacacaagcatactaacagaggattagtttacaattttttttttctttttaaaccgcacccccaaatccccaatcaatgttttttttttgtcattttgcatttctataatgtttttatacttatatttgatttcagtatttcgaaatataaatttcaaaacattgacaaattggcttccggattttaaaactcgaagttgtataaaaaattaatcctcagaatttaatttctagaaatatatattttcatagttaatttcagaacataattttttctacatttagaaaccaagtttatcggatgatgtagaatgtagagattaaaattgattaatatttttaggaaaaaaaacacgatagtactttccttgccaacaaaggctttgaagtttctatcttcttctctgcactctagaaagaaacatgatgaacttcgacggcttccagaaggcaatcgaggagcgcttagagggaattcccgttgcttccgaggagtttctcttggtctcgggctcttcctcttctgcttcagcaaggacgacgccgaggctctcctcagccaggttacgcttattgacccccacgcgcgccagggctctaaagttgtccccgttgctttgaacaaggtccttcctctctctctctctgtttccgttctttatttctctctcgcgtttggtttgctttgctttctcctccaggtgtttcagctcaaggtgaacagcgttgcttttagattgatacctgagttctctcaagtcaaaaatgccctcaaagtgagtctttttcttataattatattatcgtttgcaaatattttagttgattggccctgcgtactgtaataccgatcacacgcaaggttttaaaaaacggttgtggtttcgtaaccctccttcataatgcgggaaattttggataaatgcagtcgatgtagtcacaattgtggtcacggatactccaaataccttcaaatgtgatttttagaattggaggcagtgaggattcaattatggaccactattctttttttccttccacctctagcagatgaattggccttattcttcactcttcggtgtttttattaattcgtttagcccatgccccttgatagttggtactctcgggattatgattgattgtgatttgtgatgttgtctaatggaggaaggtagaagtttctctttgagctagtttcttttttaatactctgtgtgcaatttatgtcgacaaatctttcttggggaaaaaattactgtgtggatagaaatcctcttaacaagtttactgtgattttggattggttctcaccaattactagaattatagcttggctgctctggtgtactagtcattttcaaattatgttggtctaattagctaattttatacaattttcttaaaatccgtcatgcatactaaaaattagttgatgtgaagtttggaaatttgcttgtaatccctgtataacctatggaccttgctattggtcattgagctgtacagtaatgataatgtatgctcgtgctttacaggagagggaaaaatctggcttcgcttccagtggcttttctggtgttccagttttccaggttcttctctctgctttttaggtctggacattccatttgtgtcgaaattcctatgttgcaagctatttgacagtagggaattcattgatatactaaaatgccaatcaaaatgggaccttttattttttggctaaaacgtcaaataatatggaacggagggagtagcaacaggcccacaattaggaaaatagttaaagtatttagagagttgttgttagttagcattctgatgctgtaatagaggtaggatataaatagtgggagagaatgtaagtggaaggagttagttggttggttagtcttgggtgggagagaccaggcttttgattctttggagactactttaataagagattctcctcattctgggttccattgatccagagcgggaggatgctgctcaataaatttgcctttctttcattctgttacattcatatgataggaacccaaaccccaagctcctcctctacaggtttacaacctaaaccattattctatccatgaattcctaactatagaccacccaaaattcttgtactttactgctacccataaattgctgctagcacatgcctggagtcctgtatctttcaaacttcagattagccacccattcacaaattcataaaccacgattcctttcttcaaagttcaaacctgtgacttcggaatcatggatgccttacgcctgtcactaaccatatgtcagcaaatctcctttttcagttttgcatctttgctttcattcataagatgtgaacataaactgtgctaaacctcctttctctgcttttattgactggtgagtgcacagccatttacaccatgagttctatttatatcatgatgtactttatatcaaatcaaggatgcatatattcttatttgctcactttagagaggttagaaagcttggacatgataagaggcacctatacagtacaacttgaaatgagtatcaaacattaaaaattgtgggcatgtaacacaaattaagtatcaagtataaaattaaaacaaaaaacacaaatcttgaatcaaaagagagaattggtgttttaaagttagcatgagtctttgtagacataataaaaggttatcatgtttctagtttttgtggcattcccatatgtatcggtaaaaaatttaaatataaaagtaaaaaaaaaaaactatttgacacgaatatgtgtccaacacacaggtacaacttatattttgaagtatctgtacttccttgtttgccattttttttaatggatttgttatgtttgtgttatgaagaaaattgattgagttgatactatattagacactatgaactggacttgttctactgttctgcaagtatattttgagcactgattcttataatcttgttatcataatttgtgattgcactcatttctattgatgctatgttaccttaatttttttcatgcgtgaatcccttaactagtattttgaattgttatgttggtgagtttcagtccagaaatctgatattgaagagccaaagtaagagatttcgtccacttttctccagaaaggtgttgctgatttgctagcattgagttacctgagattaggtaggtagaaatgaagctgagatttttttgtttctcaccttttgaatttttcacaggaggacttagaaaatacacttaaatcggcagcccgtgagcagaacaaattaaattccactatgagaaaaggggatatccaggtataggcctcaatgactcccttcaatgtatgacctgttgtttcagaggactcaccatgatttatttttcaggttgccactctagaggatgtaataaaagaaatgaaggtgagtgccagagttacagtagaagatggaattttcttaattttacatgcaatgtatctatttcgtaaatcgagactaaataaaataattttgcaggaaaattctacatcgaactgggatgatgttatttttatacctcctggttttgatgtttcagacgactcaaatgagcagtagggcaggaggatgctcgaattcatgtcacattttatacttctggtagtattagctttcaatccatagcacgtggcaaacaattatttaggctttgtgcatacgaccaacttctgactgcaaactcttctaccctgtcttcaatatgaaacgttattggaaagtttgggttttgcattttccactttggttttcattatcaagttggttttatcattcttcataatctttattgctaacgtacactaattgaagtctgagatatcgtgcaccacttggaggtgcatcacttgatcgtgagattgctattgattgaatttggggcggtggtaagatctcaaatggtagctatctctgaccttgtttatctcattgagtcattgtttatctcacgaaattgttcatcactaacatgttatataaatgtggtctcattcaattttctgttcaattttggctatttcgttaatcattcgagtggtctcattataacttggaactcatatagagtgacttatgcacaaagcacttaacatacgataatcttttaaccaacgtatcgtcaactatcaaggaagttcctctatctaatacagttgtcttggctgaaggaaaaagatagctcaccctacaatttcaacaaagtataatcttccttgatagcacggacaactttaaattgacaattgccttttaaaatggggtagtgctgtagtgggagggtacaagtcaaagaaaaataggctgatatccaatccaaaaggcatacattagttggtcctccatttatggataataatattgatattattttttatttttttggtttcttgacgattgctgttataaattgctcacagaaaaatcaatttcaagacacttgaaggacaatttgtattcataaagagatgggcactaatttgttttcaattgttttactggaatttggggggaatgaaatggaaaagagaaatagatatcaaatatcatttgtttaagaacttcacccccctccccccaaattttatgttaaaaataacaatatataatttatgttaagaaaaataatggagtaaagagttaaaaatattttatataattatttgtttttctctattttctctttcactctttcaaacagagaaaattccctacttctttatttccatttttatttattcaaatatcatttttttattctatttttctttcatttttatcttttctatttctttcttctctatttaatttctaattgaaacaaaatattagagtgataatcacctccatttgttcactaataataaaaaataaaaatttaataattaaatgaaactttatattataagtacatttcacttaaatcttttttattttaatccaactcaatttatccaaactagtattcattttacccgtaatctcgttatctgataaggggggaaaatcattgaaatcacgcgtttgatatgagaagagttggagagtccccatcccaaaggaatatctcaattttcaaaccccaaaaatatgaatccttgcatttacaaaccattttttttcatatattaattggacccacctcagccatgcacgatgtgacgctacgcttgcttaattgatgaattttcatttggttttcggtgcactcttttctcctgtgtagattagaggtattgaactggccatcgattgagacttagagaccaaacaaaaatttgctcatcaattaccaatataataataacatgcatgcatgtaaccagaaataataataacaattaacaacatgcatgcatgcataccggcttttttcataaaaaaaaatgtttttacgtccgtccaaattattttattttatatttcggccttttagtttgtgattgattttgattaactataaaataaattaatttcaacacctattcagtgtactttgtacacttatgttaatttattttagagattttctttttctacaatttcttaagtgagttaaaaaaatgttgattatttcttcatacactcttgcagtgtgtttgtatatctcttatagaatcgattttgacatccaaaattaccgtgaaaaattgaagtaactatttgctgttttgtgctttaacttgattttggaattgaaagttaattcaaacacacaataagctagaatctttatattcaaattattaattcattttacaatgaaaaagacttataatagaagtttgtgttttagttcgtatttcatttatgatgcaaaacttatttctggccaagtaattggacggtgcaaacaactttgatatatcgatcccattcttgtaggcaaatactacactgacttgaatatgaatgctggttattttggcgaactaacttaattagggggagaaaaactggatatagctagatacagagactcggtcattaattagatatactcgcggataattggatacgtgtaacaaagttctaaattatgtaattcgtgcataaagaatatgcaagttttgtatcttcaatttttgtatatatacttgtctagtactatttttctaaattaactgatgcttcatttggtataaaatcatgaatagaacctgcttctagagatttcaaattccattcccacccatttctggtttctaaatattcaactcaccgtgtctgccagcccaacctgtcatatgggaaactaccattcaaaccatttttcattatggagagactgttagttcaaattttcaaatacagcaacagtggtttgctatcactttggtttgtagatcacggataaaagttgaaactatggctcaatttgtttatctggaatcaatgttcccctcctttaaatagaatattatggttactaattaaatattattatgatacgtccatgatatttaattccacaattattgtcgctaattaatggcgtatacctactttaatcttcacctaaagcatatgctatcaaagattgttagaaggagcctcatcattgacctaaggggatgaaatcacactctttttatgatctatcctttgcttttcacgaaggctgccatttgatgaggaataagtagttttgattaattaattaatggacctatacatgtgacgatatcaaccatcaatgtcatcgtgaccaaccaatttagttgaattcagcaatttcactgtctatgaattctatacactcacattcatctcgttgttttactcttttgtttcgtttaaactttccaagccacttgcagcacccatgattccatgtattggctttcccaaatctactttatatgtagactcatcttcaaccccacaaagttttaatctaaaaggacgcaaaacataattgccgaaagcatcaatcatatgcattatgcagtcgatttgtataattgtactgatatgtttattattttgttggcaaaagaaaacatgctttctgttttgattagacagaatatagaaagaagtgaaggacactaattaaattccctcaaccatacatattcacattaaaatcaggtcccttctgaggtgctgtatacattctcacattcattaaaatagtactttttaaataaggcatcatcattttaattactttttgcaagaaaaggttggagattctgctagctggttgccataagttgattcccactgaccatctccttataagttataaccaataaatttgcacttttattctaataattaactagttagtggtggttaattaacattagagggatggaaggctacacttcaatgatgatttgcactaatgaatagtagtttttaagcatccaaatactccaactcttgagttttgatctagtttctaaatgttctaataattatattataatttgtaacacttagcggtacatactttagtgatgaagtgatcattcattgccatactcttcgttactgtgccattgtggatacccttaccctcatttcaaggttgattcttgtagaacttccttattaaatgctttggaccatttatcaggaaaaaaagtaatctgtggctattgtaacattggagggtgggtgcaggtaggaagtttgttcatttactaataatttttctcattaataatctgtcatacaagtagattttaatataattgtatatgcgccgtactcgtgagaaataaatgcatattggtttgaattattatttttatttgttttgtcatgcaaatccaaagttgttgtctgcattggaaaagacaaattaaaactcaagcaatacaacaacccgagacaaagcaagcaggaaaagagttatcagcatggccgaagtggataaccatgccatatcattggcaatctcgtgactatttttttgaattttaactccaacatcaaagaatatctatatctatatgtcataaaattgaaaattaacagtgaaagtttaggcgatggtttaggcaatagcataggggcaataacgcaggtacgaactctgccacatggcatcatctaagtggatccataattcatgattggtggtactaagaagtggtaaaataccctcacgtctttattctccttccacatcacacccagttggcatccatccatcacctaattttctcttttttttgaaaaaaaaagggatattttgttccaaatcatacaaaaatggggtctacccctacatttcaggtataaaattctctttttttttatcattacttttttatttgtgagcaatatcatgtacgcaatcattgttcatacttcatattactactaaaacttaaggttcaggtgcgttgatacgagagaaaataatttatttaaaaaaaaattatgtttgattttcgttatgtgtaaaatttctttgagttgataattacatatcacaaacaaaattaatttctaatctaatgattaaaagaaactcggaatctggaatttgtgactcaggacaaagatactactactgaataagtgaatagcatcctgtgcacaaacccaaaaaacatcacaaaatccatttaagtataaccaatgcccaaacaaaaaggttccagctttcaaaacttgctaagctggcaccagcttttggtcccaccagcccaagttattgctccttcacgcgtccaaccatagtcccatacccaaatcccatcttccatttctctctttttcacacatatatatatacccctcttttgaacacattccctcacatcatcacaagaagcacaatttctctttctctctttttttgtgtgtccaaaatggctcctagttctgctcacaacaatgggttctatgtgcttatgctagttgggatagtggttagcactatggttgctacctgtgctggtagcttctaccaagactttgatctaacatggggtggtgaccgtgctaagatattcaatggtggccagcttctatcactttccctagacaaagtctctggctctggcttcaaatcaaagaaagaatacctatttgggaggattgatatgcagctcaagctcgttgccggcaactctgctggcactgtcactgcttactacgtatgtttattaatatttacaataattatatatgtttgtacattattttcatcactacaatatataatctatgatacaaacaaatatttcaaacacaacttaatacaggtttcttagctacttgtagtatcaaaattacagtttcatctagataatttgcataatatataggtttctaataaatgtcaacatagatcactgagataaactctaattctcatcacaaaataaccccaagagtatgttttaatgaaatctacccttcccaaatttttttaaaaaagagagttaaaaatgctataaattttgtgaggtgcaattatcatgttatctgcttcatcttttttatttctggtatactcatttacccttgtttttaccatataacaaaactatactaattcaaattgattagtttctttccttctccatatatatatatatatatattatatatatatatatgagctaaaacagtaatactgtagagtttttgtatgtgtgtgtatgtttgtttttcttttaggtagttttagcattgattcttgatgaaagaacatgacttatcctgtcttcaaatacgaccactattgaccacttttacacttcaaacatcaacctttgtcaaactcaactgtacattcacgagaatgctattgtagcaaacccacaaaaacaagttagagtacagaattttactttgtcaacaactaatgctttatttattcattccatgctgctttctgtttcaaacattgacgtatttttttttatacaattcaaacattgacgtatacattaatcaacttggtctttttaaagcagtgaatttaacaagcgctcgtgacaggggaaggtggctaactttgacctagtccaaaacattaacaacttttaatattgaaaacttcggttcatagcataatctaatgacaaataaaaaaaaacgctctcatggtcgaaccttcacataaaaatacttttatcacaatgagttttctggttttgaattgataaaaaaaaaaaatctaagaccttgtttagttgctaaactcatactgttcctatgcatgcacactatttaaattactgttaataaacaacaaaaatgacaattccccaaaataaggtcattttcttaatttgtcgagttgtttgtgctgctaccacacacaaaggccatatcaataactatagtagtaattccattttctgcggtgcagttgtcatcccaagggccaacacatgatgagattgatttcgagtttttgggaaacctaagtggggacccttatattctccacacaaacatcttcacccaaggcaaaggcaacagggagcaacagttctatctctggttcgaccccaccagaaacttccacacttactctatcatttggaagccccagcacatcatgtaagtcacaataaacaaatattaaaaaaaatacacattttttttattagtaaatattctatacactaatactgcaaaagattttatatcaactatctttgaactataagtcataccatttgaaagtgtaaaaaatttacattgaaactggatagaaattaaactttgtttatctctatgcttttcaccaatatccatttaccaaatcatgaattgggttaactgcagattcttggttgataacacacccataagggtattcaagaatgctgaacctcttggtgttccttttccaaagaaccagcccatgagaatctattctagcctctggaatgctgatgactgggccaccagaggaggattggtgaaaactgattggtccaaagcaccctttacagcatactaccgcaatttcaaggccattgagttctcatccaagtcttccatttcaaattctggggctgaatatgaggcaaatgagcttgatgcttatagcagaagaagactgagatgggttcagaagtacttcatgatctataactactgcagtgatctcaagcgattcccacaaggtcttcctgctgaatgtaaacgttgaaggttctaagagatgaagagaatggtcactttctgagttggatttgaatggtctatgtaaaatatgctatgtttatgtcttagattctttactgacttctgtccttttttttaagtatctattttatagttgctaatgtatatgtgtattaaggggccttaataataaatcatattctttgttccacttttcttgtcaatttgggcagttggtctcactctcatccaccctttaaaactgatcatgttggaatcaacttttatctgttcatataataaaaaagttgtagtcaagtttaatattatcactgtagttgtggtactgaggttgcactttgctcatcttaaatgacaataattaataatcaacactcggaaatatcatgttgccatgaaaaatcgtagaccttaaacattcagaattagtaagatgactgcagaaaacaagattaaatgagcggattcaaaaaaacaaaattaagcacataaaaacattaacatttgtaataaaaattattctgagcattattggtaagagatctaaagagaatatggaatttaaatggttggcctgaataatttgcaatagttccattcgtacatatatatatatatatatatatatatatatatatatatatatatatatatatatatatatatattatataaatgctattttgaaccatcttctgctatcaactatcccacttcccaccattcagatcctctttccattttctctacaaaaaattctagacatacatttacgtttaacgattgagataaattaaattagtaaaagtaataaattgttgatctatttattgtactggttattataattttaagattcaccaatcacaaatgtaagattgatttcttcaaaaaaaaatgtaagattgattaataacgtttttttaaaaaaaattggttaattatttttgtatggagaggtgctcgatggaatccaaattgaaacaaaacatcaatatacgtactgactgcatgctcaaaaggtttcataccttgacttgagcaaatattgtcccctcggccaaacataactagtctaacagttttgtttgtatctataattattgtgtaaatgattgtacttagagatccctcttcatgaaaagagagagagatgcccagactcctaaaaatatctaaaatgcaataaaaatgattgtttgttgtttgcatttaaaaaacagcaaaacctttcgtgctaaaataaacttaccaaacaagatggaatcaaggcttcaataaaatgctcaaaagctctaataattaagcctttcgttagtggatttgtcaaaacatcaagtcttctatgagactctagaatttctctcccaatttctcgtgctttgtcatgaatataaaactaaaaaaataaatattactttcaaatcccatctaagattggtgagctttcacagttaaagtatctgaacctttctgaagctatttttaaatttttttttggcgaaatcctacatcaaatttcacatttgtccaagcaactgtcacttgatctatgtagtgcattttattctgtctgcaataaatcttatgagtctcaatatccactctaagaagctgaattcaaaactcgtgtaatcttgaaatccttcttagttcttattatgtttttgcacatctgcaatcattccgacagtgtcatagttattcatgtttttttatgccgtgttgttgtgtgatattcttctattatttccgaatcaaaattatttatttatattttacactagttagaatttatgttctcgacttctcgtacatactatttagaaacccatgtcgattccagtggttcgaagcatctgaactgaaacattaataattgaaatttgacgtaaaaaaaagttgtatctgtacttatacttgattaattctaatgtgacattcatttacagaaatttttaatcgagcaccaaaacattcatttgtttagaattttatttcggtaatcatatttatttttggtaaagaatactaaataaaaaaatatttatttgagaaattgaataaaaaaaagatatttgagaaaaacagaaacatattaatcttaaaaaaatagagcaaattagaaaattcataactgagcaaatatttacaataacaaattccaaaaaaaatctgtaaggttattcttgtccgcttctactcactttcttcctgtttcaaagggccaaacatatttctctgatattcagttttccaaggctaagctgagatatattttatatcactcctaaaaacaattccaagacgagaggatatctgctttgagaccgcaattgcaggattatccgccaggttgaatgacttctttttcaacatgaaccgcaaacgtaaccgttggtggctgcaagctctgcacaaacaagttgaaataaaacagttcaaatggaggaaccaattatgggtattacatataacataatcatggttcatgcacataccgttattctgcaatgaatattaagatcatcgtgcatctgactaagacggttctttgcaagttcttcagctgcacatgctttcctgcaagcttctttcacctgaaatatacaaggtgtaaaaaagccttagtttggtaagcattttgcctatacagacacgaaaaatggatggaattacaagttcaatggtaaactagattaagtcaaaaaaagtttatgaatcggacaagtaaaaaaagaaaaacaattaaataatagtgagaatgaagctatatttgcatagctcaaatgcatttaaaaagaaagctacttagatgtttgtcaatacaaagtgcccccaagatagaacatggccaaaattaactaaccaacaatccttcttcttaagcctgaaagcaatatattatatacttgtgaagaatgaatcctttcatattcaatttttagtttcccatgattttatcatgtaaaaatcttgtttattttcccttttgattgattctcaacacatcttgatacaccaatttaatatctattaagacttaatagagatagatacaattttccatcataaaattcacgtgtgaaactgaaagggcatcaaaagcttgacaaaataacaagaattgcaaggtgataaaatagtgatccagtgatcagagggaataaaatcaaagtataggtaatgcaacacatgtcaaactctacctaacacattagagagacgaactacaaatcaaggtagcacgcacctggcttccaccaaaaacgggattattgttgacactatcagcagaactttctaacatatttcttagatgagatagttccttcataagattatgagcaacctcttccgcatctaacaattgatttttagaaaactcaaatgctctttctgcatgaagccgaaaagaagcacagttcaaacatgcacaaacccctctgcatcctcttggatttctttttaaaattccttttttcaaaccaacagcgggaactctaagttgttctacaacttgcagttgagacaagctctgagaacattcgtgtgtttcaggtagcttctcattagaagacatcaggaaagaattgtttccttttacttcagagaaaactgataatgacttggacgagtcaggtgtagcctctctggtggtaacttcattaatcataggtgccaaggttgtgattggtaagtctattccatgaacagaaattgatggatcagtggagctttctggcttgcagagtccatttaatacaacctgttcatcttgcagttgaatcactttgcatgaatcatgagatgactgaaattcaggaatttgagattttgggcttgaactatcattgtttaaatcacaagcctgcaaccctgattgttgctgaggacaagaattgcctgcaaaatgttccacgggaacacaaccatttgaatcatttacaggagttagatgtaaatttgaagttgaaattggcagaggtgtttgatccatggatttcgcaagttttgggtgatgatcatttactgaagcacctagaagtattagaagtttagtttagaactacagctgctgtgaccaagaaaaaatattgaaagaaaaacttaactaaacgagtatcttccacaagaataagaaccaatacttacaagaatcatctttcatggtatccaatataaatggaagcaatctcttgtagtttaaagatccagcatgtttcaacaatttaaactgtggacagcgtttaagaacctgtttcaaaaccacataatcaaacatatttcaaataaatatatcacggggacaaataattaagtattagttaaaaatcaatgagtgaaaagtagaatcataatgttgtttgttaatgcaaattctaaggaaatataattttgcagtagataaatttagggtcctcaccgaagtgatcttggattcagagccattttttattccactagcatttttgttatcactaccttttgaaggcattcttgaacataaaactatcccattctgcacacttcctgctttgtcaccgctatgccctgccatgtcagatttttctgaggtaatattctcagatggagctccaagtatatcatttgaaacctggacatgatttaaacttgttacattctcctcagcatctagcacattaagatccaattgacttagagtctgacattcagggggaaatctgctaacagattcacgctccttcagattcacaaactgtttgctttcatcataagcaatagtgaatcctttttctttacttgaacgatgcacagatgtaagcccagagacatcacctttgagataaagcatatactgatctttgggtggtgagtcactatcgtgttgtctggatatcgtattttgtacttccttgacgccatcattatgcgcaacattcttagcagagtgaaaaccatccaccattactgaacatggattaagctctgatgcactcaagcattcatccttagaagcaattgcaaagttctctgtatgttcattgacagagggtgcagataaatcaccgcgaaccacttcttttgcgtccaattgcattggaaattcaggaaagtcttgggaaggtgtcaattttggctggttgccatgagaaggattaactaatacatagttttccaaaccattagactcaactgtgccatgcatgggactgctgtttgtcttatgctcatctatagaagcttcttcactttcagatgacaaaggaagttggaacctctttgcctcatcttcttgatgatgtgtctgatgatcaaatttggatctatctgtaaaatcaattagcttcttcattatcctcatctaacaactaatgaaatttatattattaaagtggttgaatacacaaggatagttaccagagtcatctttggtaagatccattagaaatggaagcaaccttttatagctgacagaacctggggttttaaaaagtttcctgtgcaaaagttgtctcggcacctgcatggacatcccaaatcatatttagattgcaactaaatgtaaaacgatattgttaatattaccaaaaatacaggcacatgagatgctagaaagcccactaattactgcatcaaaagttttttcttgggatataatatcataatatctttcatcacctatgcttttgagacctaaatttgattaggtaactaagttataataatttagcaaagatcagtaacttaatgtctaacccataattggtagcaaacaaggttagaaacaaggacagattcttacggatttactcttaagagaatctttcaccttgtcagctttcagacaaaacccttgacccgcattttcatgagtgcttctggtaaaatccatgggtttgacattgacctctgaattaacatatatatcagcatcaggaggagttgtctgtatacattcttcattcaaaacaccaaactcctgtgaggtactagcctcaacacaatcaagattattcatgtggctagacaattgcttcaagccatcatcgggcaaatcacttgtagcatctttaacaccataatctgcagtggcatccgtcttaagttcttgtttagactcttcttcactttgaggtgacaaaggcagttggaatccctgtctaccctcctggtctttctggcaaaatcccaattttggtgtatctactaaaaattagcagaccaattagctcattcatcaaacatatccaactaaatcatcaactaataaagtaaataaaaaataagggtttgcctcccaaaataattaccagaatcatctctcacggtatccttttgaaatggaaacaaccttctgtaattgactgaacccggggccttgaacaacttcccctggaaacatggtctgagaacctgcataaagatcccaatcagctctataataataaaaccatgttcccaaagcaacaataatatttaaaaacaagtactattcactggaattttaccctagaacacccacaataactcatttaacctaattacacaatttgccacaattaaggttagggctaacaacaaaggatagaatgcctaattcataatcataaagaaacctgttaagggtgtggtcagcgcttcaatctccaggtacatatgtatgaaattcacccaaattatgcacaaataaacataaagaaaataaattaaaacatgtcagacccctacagatttgctcttgagagaagaaccattcccagtggaaggtgtatctttgacaggaacctctgcgtccagtttctctacatctttgttaaccttggaatttgaaccaccgcaaatctcagcatcaggtagagttgttgctccgtccaaaccatcaaatttctccgaacaatctccaccgctctcttcaaacaaatcagcatttcccctatcgaaaccccgagcctcgaaaaaaagccccaaatcgggactcccgattgcttcggcgtttcccttgggaaacgcgctttcgatcaaaccggaattagtggattgcggaggcgaatagactcgcctggcgcgaagatccttggtcaggcggcgaggaaggtcgccgtcgtcgcgcttcgctttcttgcaattggttcggcgaaagccaagaagttccgcgcagggttcgtccagtgagggaacgggatcgaagcggagttgaccggagcggttccgatgatgatagagctgtgatctggcgcgagtgagtgtaccagaggagtggctccgctgacgggaacttgggacggtgtccatggcctctgagcgcgctaatgctagatctgcgaaatttggcgccatacttctatatatgactcacatttgatggcgggaatgttttggcgggaaaacataaactcctttttagttttttttttttttacttcgatgtttattatatcctgtatcctattccttatcaactgtttttaagaatacttgagaaaataataaacaaatatttattttatataattataattaaaattaaattttataataattaaatattttaacatatattacgtttataataattaaacaatatattagaagtaaaattgactattcaataatgttaaatgctttatttattaaaaaaatagtatgtattaaaattattaagtttacaaatcaaaaatcaattattttaaatatttataacttttgcaatagtatataattatatattttttttgaaatattttataaattaactcttttaaaacaataatacacataataaaaatatttagtggatattttaattatatattaaatattttataaacccaccctccctaacctctcctttctccaccgactacgccctctacgcctccgagttgaagcgtcgcggctctgaattcgtcaccaatctcgatcatcctctctaacacgcaagagggtcaccctttcacttgattagtccacaccgtgatccttccttggatgaggtgaatgaggatggcatagtagaaaatgaagaaattaggagagaaaggacaatgcagaaaagttgaaggggctgtccagggaagctgtcaaggaaggtgcctcttcggataacaatctaagggcttttctggattatgtttacccacaataaatacagacataactttatggtattttaattatttaaagaacaatattacttgcgaaatatactataataaatatagaaaatgttcaatatatatattgcggaatgtttacttttgcttttcagttgtctttatttgtaagaagttgttgattaattttagcatacaaaaaaaatattgttaatctaattattagcgttaaattgtttataaatataatatttttctaaaattttccttaatattattggaaatttattcatctttttcaattttcataggaaatgaaaagaaacatttcagaatgttatgtattaaaacaaataagatattttaatcgaaaataattaataacgagacaattgaaatgaattctaataatttttttttttaaattgtgttatagaggcaaaggtgatatgttaatatatagagagagaggggggaagagaaaaaaaaaagtgtatttgggtaagcttctttaaaataaaaagaaagtgatgagatgaatttttttaaagctaaaataagttatacattgattaataattagttaatttatataagttttcttatataatttttctaaaaaataaaaaagatatctacaagttagctaatgattaattaatgaataactcattttaactaatgaaaaaaaatattttatttttttcttcttctaaatttttctagaaaaactgaaagactttagcttggttatatttatgaatatgttaggatgtttttcaaatacactcttttctcgctgtttaaaaaaaaaaatacactctcttctaataattaaaagttattaaaaatcataaatttgaatggatctcatttttcattgagtaactctctctcgtgattttatattatctctgtgctttttattttttatttttaaaaaatatgtaaaaaccaagaaacataataaatgtgcttcatcttaataaaacacttctttcatccttaaatataagacttttataattaattcacacttattaataaaattacaaagacttttataattaattcacacttattaataaaattgctcgatttagttagtaattaacattatatttgtttgtaattttaatattttttaagattatctttaaaattattcagactaaatatatatttttttcatttaattattttctacccaaacaattaacatatgaaaagagaataatagtagtcgagttttaattttaaaattaaatccttcaattctccaatcctcccacgaaagagaaaatgacaattcatagcaattgttatttatagactacaacaactaggggtattctagtaaaaagaaaaacaagtaatgcaagaaagaagtcttatacaaaagaacaaagaattttttaaataatgtcttatattcatagacgaaagaaacaattgatcctttatcatttttattaaacaataaatgcatagatgtaaataaattaaagattagaaaaaagtaagaacataattggcaaaaaaataattaatgtcattttgaattttgtaaattataaataaacaaaataatttttaataagttttaactaataattaaatataaattaaagggtctgttgctaaccctccatttgggactatttttgttagatttttttaaaaaaagaaaacgtgggagagtgcaattaggataaagggattggattacttgaagaaaaaaagaataaaggggttagaaaaagaccctctagaagtatacgacagcctaaattgaaattgggatacatagtttggactgtaatagaattgtggatctgtttgctcgttttatttcaaaataaaacaaaataaagaactcctagcatgacaacaaaaagtactaatttttaatctcaaggatcagaactttgcgtttctttcccgtatcttgtcgaattttcattgtaagaaatattctttgtgggttcagttattcaccattattatttcagagggagcgatgggtggaattataatacttcttcatcagattcaattttgataaagaaaatcattcaaataagagactttattatcttcaaaaagctaagtacggaagatgccaaaaagaaaattcaatcttgaagcaccaatgaacaattacttgttgacaaagtctatgaacacattagaggtgtcaagcttattgttagctaatgttctgttgtatggaaccgagcaatcccctctaagatgtctttcattctatggcttgttaaaaggaatctgctgattactcttgacaaagctgtttttttgaacaagggttttctctgccctctatgttcaaataaggctgagtcaaatactcatttattcttttcttgcaagaaatttcttcaagtttgggttcacattcgtgatttagctcctttgtgcaggtgtttcacttctttgcaacgcattactgactatttaattaggggcagatccacatcaggtgttcaagaaaaatttcgttgtctgactataacaattacaatctactgcatctggctgtctaggaacaaactgatttttgaagattatcaattttctgtaatagaggttattagcaagattaagtttcttatgtatagacaagcacacttgatgcatttgttttaacatcttgatataaaccttcttgtattagggagattttttattttctctagctgcagggtatgtcccgttcattattgtatcattttgggtttaatataatttacattttttcaaaaaaaaaattgtagatctcttgtagattatgaaaacaaaagctttttgttaaaataaagaagtgctaaaaaattaaagaaggtttaaatacatttatgaggtgtgtgattttgtttcctagtttttaattttgcaaattggatcatttaatttatgaggtgtgtgattttgtttcctagtttttaattttgcaaattggatcatttaagtattacaggaatccaatttactcaattgaattctgaaagatcaaaattaaataaatgcaatacctaagagacaaaaaataattaatctatttttttaaagaaaatactactatcagatatggaagcaccaacaaaaccagtccaggagagacatcagcacctacctacgcaccccaaaatcagatacaactttaagcttacaacatcacctatagtaacctaatattgctcaaaatggaagcaaccattccacaaccaatacaacaaacaaaatcaataaatttactacaaactagtcgaaccgtacctcgttaatgccataaacctagacgactacaccaaacattagcacgaaacaggaccaaagtttttttgtgacataaggtgccatggcctggtaggattgaatattattttctgatacattgagtaaatggaagacaacaaacaaactaagctacacaaactgaatcacgtctaagacgctctaaaaacaaaatcaggaggcaggttccgcaaaataggactggataatgatgttgaagcagtaatttctatcaaaattaacaggaaaaactctaaaaaaatcagccccaggagaaatttatatatattttttgtagataaaaatttaaattaggggaagacacgccttcttgtaaaactacaagaaaaattaacaacatcagcattataaaatttatacatcgcataacaatatgcaaaatccaaaaatcaataaacctaaattattgctggtataactatttgactaaatgtgccattgttggccagagaatattaaaatgtaatgaaataaagtattttaaattaattgactaagaattggcatggctatgagaaatcatgcactaattgagcaaagatatgatatattttttatacttgtcctaacaatgtactcccactaattaagttactaattgagcactccataattttttttggaagatgttctttggacactgtgagaggtgtttataaatcgagagagagagaaatattaaagaaaaaaaagctaataaacgttttaaagagatatatatggtgaggtaattttgattttgattttgtttgtaccttaggttttttattgaattaaataatattgttaaggtcgaatagaatcatggaaaaactttttttatatgtagaaattgaatataatattaaaaaatttatgataatcatttattttatttaattaattgagttaaattttcttactaataatgtattttttatttgtcagtagtttttaaatatcaaatgcatcttttggaatcttcccaaaaggtaattttaacatgattgacttttcttcctttccaattagttttgttagagcacgtgctgttattctagctaattatttaccctttttgagtgttatttttatcttatgtataaagtcgtgtctataattcagtgagttgcataaatgcaacacataactaaatcatgtctaccaagtccgactaacttttccgtccatcaaccattttttaactgagaattggtatgatatcaagagttaagagttgtgactgtatttggaaaaatatttcttaaaataaaatgatattcaaaaaatatatttttaatagttttttctgctgattttcagtctataattaaacgaatttagatactctatattaaaaaagagaaaatcattttttcaataacagtcccaaaacttttaaattaaaaaaaataaagtaaaatttatcttttattttgaattaaatcaagacatactactatacctgatcagtcctggatcgaattctcccaaccaaatcaactcgccataaataccctcttatatccagttaattaatggtccatctcgttttgaaaattttttaaccatgaagtttttttttagttacatgaggaaaagaaagacaagggacaaccaaaaaaactacacgtactactaaattaaggcagatcacactgccactccctctgcacaaaaactggtggcctctgccagaccacagcatcagaactcagaagcattggttgcatcagagttttgttatggtgtatttagaaaaatctttcttgaaaaaataaaataaaacggtatttcgccaacaggtcagcaacaacgttagcctccctaggcaccacctccaatcccgacacaaccagctcgaaattttccgcaccgcagaatgtcgtgattcttgtggcaaccagagttgttgttcttgctagctctatattcttctcctgtgtggcagtattgcatcaatgctaccatgcagtgtctaacaagactatatcatatatttatgatagtctctaatcaatttttgaaaaaattagagtcttaatatttatacatctcattttcttataattcacttgcatcttatttcattttttcccctatcatataacatatcatatttattacattctctctatttttatttttatttctctctccatctctcttctcttttcaccctaaaatgggggtgaacactcaacatgttttgaaaaattattattagattaatatgtattgaaattttaattaattatgtttaataatgtagaatccattcattctagtatattctttcatctctctttctttccttttcatttatcagtgttaattactagtagtatatgctaaggaaagactagtgagatgtgcggcgtgtaaagatgaccacccacataacaagtctggaccaaaatgaagtcccacggatattcgtcacctcaaacgtcacattcataacaaatcttaagcaattcacaagataataaaatcaaccatgacaagttgcacattgcatggtatatatccaactgagactccattaataagcaactgcaagtacacacgacacaatccaaatcaagcatcaccatgttccgccaccgcttcctcctcatactgtaccccgcacaaggccacatacaccccgcattccaactcgctaagagactcgttagtttaggcgcacacgtcactgtttccaccaccgtccacatgcaccgtcgcatcaccaacaaacccaccctccctcacctctcctttctccccttctccgacggctacgacgacggtttcacctcctccgatttctccctccacgcctccgtgttcaagcgccgcggctccgagttcgtcaccaatctcatactctccaacgctcaagagggtcatcctttcacttgtttggtctacaccacactcttgtcttgggtcgctgaggtggcgcgtgagtttcacctcccaacagcgatgctgtggactcaaccagctacgatactcgacatcttctattactactttcacgaacacggtgaatacatcaaagacaaaatcaaagacccctcgtgtttcattgaattaccaggattgccattgttgcttgcaccacgggacctaccctcttttttattgggttcaaaccctactattgactctttcattgtcccaatgtttgaaaagatgttttatgatcttgacgtggagacaaagcccagaatacttgtcaacaccttcgaagccttggaagcggaggctctcagagccgttgataagttcaacatgatcccaatcgggccgttgattccctcggctttcttggatgggaaagatactaatgatacttcatttggcggtgacatcttccgcctctctaatggttgcagcgaatggttggactcgaagccagagatgtcggtggtttatgtctcgtttggtagcctttgcgtgttgcctaagacgcaaatggaggaacttgcacgtgcgctattagattgtggaagtcctttcctgtgggtcattaaagaaaaagaaaataagtcacaagtggaaggaaaagaggagctgagctgcatagaggaattggaacagaaggggaagatagtaaactggtgttctcaagtggaggttctttcacatggttctgtgggttgttttgttacacactgtggttggaattcaaccatggaaagcttggcatctggggttcctatggtggcatttcctcagtgggtggaacagaagactaatgcgaagctaatagaagatgtgtggaagacaggggtgagagtggataaacaggtgaatgaggatggcatagtagaaaatgaagaaattaggcggtgtttggaagaggtgatggggagtggagagaaaggacaagaattgagaaacaatgcagaaaagtggaggggactggccagggaagctgtcaaggaaggtggctcttcggataagaatctaagggcttttttagatgatgttgaagtttgaccatatggctgtcacatcagcttttccgtttctgaattttcctgtccgtttcatttttcttttctattattgcatttgcatgactgagaatcaagtgaaatttcttctatattagtttgaaatttaaaaatatctaaatgagccatgactccatgagtagtaattttgtgttataattgatatatatattttctcttaagtagtggccaaaaatttaatctttatgtagatgaaaaacatccgctgaggagatcaattggttaccaaaaaaatagtgattctgcagttaagtgatgacaaacagctaatggaaaagggcaacttttccttttctaaatatgatgaggtcgtgattatcgctaattttcaatcataatatcatcacttaatcgtccataaaggccatttcaatcaaaaaaatagtgattctgcagtttagtgcataaattcaacacaatcgtccatcttatactgataacgcaataatttatgctcttcaaagctccattacaatcttttggtgcctagctggaagttgtttttttttttttcttttaattttgttatcatatattgtttatacatgaaggccattaagctatgttcaagtcccaagctgaacataattgcttatagaaaataatggcacaaatcagaataagaaaatttgtaaacacgcaacaaaagtcataattgcaaaatctcacgcttaatagcatttccacaccctgcacactgaggtttaattttccgtccctcatagtcctgcagtaggtatagattattcgtagtttcatgtaaaactctaattaacatcttacgttggtagttggcacatacttgtcactatccaaacgggattcgctacttaatttgcctaacattttttgtcaccaatatatgcaatcaatgcatctggatctggtttccctattcatatttccaaagcttgcatgctttctggtttccttgccaatcactgcatggaacaatcttaccatcatagggcatgcttctttttttaagctcgcttgtggtcttcttttggtacatatgctcccctcccccctttttgtttatttttgttttatggttcataatagagtttactgatgaaatagccaaatcatagaattagtaaaatatcatgtacaaggtcaaaatagtatttttagtaaccatcttttttttctcgtaccttacatagaagctgactcaatgataaaggaaacctaaaaattagtttaaaaaaaaccttttggcctttttgacatcatatatgatatttttgtcaaaatatgagactttttttttataaaaactaataaaaaaatattttttattggtaaacctagaacttaaattttagttattttattcttagagaaaccttacctaacaaataatttaattcaaatatttgcctttcattctattttatttcaccttaacaacttccctggccacaacatgttggatctcagtaaaaattgatggtgtaagatcattccattacgaagagatgcatggcctattattctttctccatccaagaaaaaaatacatttattcttgcttcctgttaaaacataaaaagacgttttaccttagtatgataaccttcataaatagttaaatatagcattgtcttgaactttgaaataaattatgtttaattagaacttataactataagttacctgaaagaattgcgttcaaatgctagctagctaatgcttttgcattataatcacgagattaaatagtatgttacatcatcaaaacattaaaaaagtatatgtaacgctctacgttaagtgagaaaaatgtataaaataaaaatctaaaaatttcaatggttgaaaatatgtcaagtattataataaatatttaattatataaataaataattttattcttaaatataaacatttacaaagttaaagtaacaaaaaagtaagtttttaattctcttaataatgtcatatcctaatttcgtactaggactatcattcgtcaacgttttgattctccattgtcaaattgaattgttcgacaccagttgttgtgtaagacggaagattattcgacatttcagtaaagaatgcaaaaaatgcccaaatggaaggacaaaaggatcattttaaggctttttcagacccctgactcgctcaggctagtctctggctcacctaggcccctaaatagtttaggggtgaagtaactagctcgtctggacgagcaaggttacttcaggttgaagcaacaactcgcttgggtgagctccagatcaactaagtcccctcatttcctataaataggcatgaggggctgaaagaaagggttcagccttcagatattgaaaggatttagtgaaatttgaagaaaagaagaagaaataaaggaaaaacaaggtcgaggtgctaccgaatcacgatcgtaatcgattttcacatcgttcttcgttcgtcatccggttagtatttattttaagtatttcaattcaatctatgcacccataagggtcttctttgtcgattcatgcatcttcatctcattcttctactatttgtaatctattttcttttggtaaagtgagttttgaccggtcatttacgtcaccaaacatcttttaattagtttgaagtttaataagtgaaatcaagttaaaatcaacatgtaaccgagctttttatccgcaaaattcacttaaatccgttcaaggtccaaggccttaatggtctcttttatttttgttggttcgaatgaatttttcaaaagtttaaaatcaactcgacacgcaattttcttgttttaagaactatgtaggtctgagtttctcatcgcacttgaggatacgtaggagcaagggcaacgcctttgtcgacccgaaaaaataaagaagcataaaaagggaaaataagtaatattgaagtcacgtttttgcacattcgattaaaggttgtcatcccctgtgacgaacacgtggggtgttaatacctttttcgctcgtaaataactcccgtacccttattttcaaaattcgcatatccccctttttggtttttctaacgttttcctcgaataaacgttggtggcgactcccgcgtgtttttctttttggaagacgcatccttgagtctcgcctcacccctcccgtcgaagggtaggttgcaacagataataataaaaaaattcaaccatgatattcgcaacaataaattaaatgcacacatacatatatatagttataaaatgatcacaaatttattcacacaacaaaacaaaaaatattcaagtaaataaacatcaacacttcactgcattcaattcttgaacaaacaattatcactaacatatgttgtgatttccagagtcactagatttaactctttggttctcagaattagtgtgagtctcagattcttcaaatggtctatgagttcatattcatgcagtaacgtctcactgcttttcttatcatatatgaaagtattcaaaatctcttcttcatcctagatggaggtatctataacttcatctccatcccaaatgaaggtgtctcgtacatattcaattctcaaaataaaacataaattgtcactacttcctaaaggatgataaccaattcacacatatttataaaatatcatttcaaataactatcaaataaatactttaattccatatacactaattaataacttggaaggtcataccttagttatagcatcacgtaagtcaatttataattaactatgaaataaaacatacacacaaattaaaatatattttagttgctatatatgatagctaaacacaaaatccaaacaagctgattgatgaattttcaaataaattttaagattgaatatgcaactagtgaatatttgtacattgtaatacctttttttttgtaaaattaaattaaaccccataaataataaaaataacatgtatgattatatcagacacttaaataatttcatgtaaaaatactatggaacctaaaatttgaatctagtttctatcgtgcatatttgttgaagttaaacacaagatccaagcaagcacatatgatgcattataattgcactaaaatttgaatatagtttctatatatcgtgcatgtttgttggctctccttgacaagcatatctatttaatttatacaagtagtaaataaaatgataagactaaatgatgagttcacatatactttatttgtactcatatatatatatatatatataattcttggatggaaaggaccccgaagatacttccttgggtggtgacttgttaccggtttcaaatggttacgttgagtggcttgactcaaaggaagacaagtccgtggtttacatttcatttgggagctactttgtgttgtctaagagacaaacggaggaaattgcaagtgctttgttagattctggttttccattcttgtgggtgattagagtgaaagaggaagaagaaggggaggaggtgtgtttgagaggagttggaagagaaggggaagttggtgaagtgttgttctcaggtggaggttcagtgggttgttttgtgacgcactgtggttggaattcgaccatggagagctaggtttcgggggtgcccatggtggtgtttcctcagtggtcgtaccaaaagacaaatgctaaactgatagaaaatgtgtggaagataggggtgagggtggatcatgaggatgggaaagtagaaggagaaagagattaaaaagtgttcggaagaggtgatggggagtggagagttgagaatgaatgtaaagaaatggaagggtttggccagggaggcagccaaggaaggtggtccttcagatttcttgatgccatgacgttgcagaatcgataatcaatgcacgtgtttgccaaataattgacttggattcccgtgttctcagttcttccatgctaaattattctttttctgcttctttttctttttccaatcaattgattctatgtttaagatttttattatttagaacaattaaattattattgttttaagagatagtattattttaagtttaaatgtatattttttattcataattatatctctatttaatctggtatactccttaaaattacttttatttaattatgtttttttttaaaataatcaaattattcaatcttattgataagtggtttgtatcaaatgctcacctaaaaaagataaatagactcccaaatattagacacctaacaagaaatcaagaatatttagctcatcaaataagatgagcacctgttataaattttgatattattttttatttctatcaataaaaaaaagacacctaacgagaaaaaaatataaatattattatcaaagacagatgcaggaattaggacaattgtgccccctagataacttttttacttgttatatttgataataaaaaatttgtccccatatagatgttgcatccaaaagataattaatttcttttaaatggatgtaggaagagactaaattattactaatcttattgctttatattttttatagttatctttccactcctacagtacgaaacacatgtaataaatcagtgccattaacatacaactcgacctaattgtaatttgtagtaacttagatagtttagattttttttttgttatggtattatgtatttcataaaaatttatattaattttcttttgaaaaatattatacttcatattgtcttcttgcctttgtaaaataaaagtgttaaaatatcaatactcatgtttatttgaacaagtgagatgcatgtaatcgctatcattatttaggaatgctaatgaacctacttgttgcactaattaagcctgtttcaacctgtaaaaaaaagtctgtttcaaaattattttttatgcattttacttaaaaaaattagacctaatgaattttgaatattgatttgatttttttaagagaatatatttttgagttatatatatatatattagtagtcctacctcgttctaatattttatatttttttaataaaatatacaaatttttaaacaattttgtattaaggaaaaattaatcattttattcttataattatacaaaatttagctttgaatgaccacatttaattagtccatgaagaattctttttggatctctttttgtccttgtcattacaaaatcaatatttaaaataattcgtactaaaaccacattgattttttttttttgcatagattgacaaaatgaaagtttgaatataaaaggttactttgtttaaacttaaaaaaaaattctaaaaaatattttttaagaagtaaatatgatttatttattaacaagacatttttctatttttaagaaaaaaatacataaaaaataattattttattaaaaaatgatccaaacccttcatcattaatgttaatgattaatctattaattcatgtttaatttattatattataattataatagattatacaaaaagcaattatacgatttaatgttttatatatttaattttatatttaaaatgtggaagatgcgttagcaagtattaagatattgactaaaaaagaaaattaaaaaatatataattaaaactaaagcattttctataaataaaaaatataagactttttttttacatgacatataaaacttactctattcaatattaaaattgttaaagatttaactggtatatactaatagtgtaaatatattttacacagcccatcaattacaaaatatcacatatttaaaaagttcggattaaaaattacatataccattaattgtgatttattttatcatagtattattacaaaataatccaacaggaactaagtagtgataaattttcgtatatttttctcctaattttgttttatttcacgtgccaacgtacttgattgttcgtgtaaaaaatgttacactaataatatgtgctagtatcaattaacctcgtttttaaatagttagaagaatttgctaatttattattaaatattcattaaaagtattgtaccggccactttaatttattttcaaatgccattaaaataaaacaatgagttaatgaaatattaattaagaaatgcatttaaaaatttattaatattaaggatcttattaattaatgtttttttccccacaagtctgcgggtaatcctgaaggtacactaggacgctaaatgtcaccacttcaaaagaacattcaaatattgattcatcatgtagtgaaaaactaatctcttttactcaacctaacctgtatcgatgttaatcattgctcttagtacattgattataaaaaaaatactagaaagataaagtttttgttagaaatcatttgcgagtatattttaaaataattgaagaatacatttttatgcattatatagttaaagtgttttttttttccttttttcacttcctctattttaaccactattttctttctacacacaaaaaaaaatccatcatttttcttttatccttttaacaaattttggttttggacagtaaacacacacaaaatatatatttttcttctaatatgatttgttttatttttgatgccaatatgttatgattgtttgataatgtaaaaaatattagactaataatgcgtagtactagcaattaacctcatttttaaaatagttaaaagaacttgctcattcattattaatttttcattaaaaatattgtaccggccactttaatttattttcaaatgctattaaaataaagcaatgagttaatgacattaattaagaaatgcatttaaaattttattaatattaaggatcttgttaattaatgtttttcccccacaagtcttctctttcaaaggcctaatgtacattaggacactaaatgtcacccctttaaatgaatattcaaacattgattcatcacttagtgaaaaattaatctcttccacttgactcaaccggtgctgatgttaaccattgctcttaatattggttataaaaaataataaaaagataaagtttttgttagaaatcatttgagagtatatttcaaaataattgaagaacacatttttatgcattatatagttaaaggttttttttcctctttttcaccttcctttatttgaaccactattttctttccacacacacaaaaaaaatcccaccatttttctttcatcccttttaaactcatattttcctaattaaatcaaattatttctaaatctcaattactttaaaattattataagaagccaacccctactaaagagtgaagagtgcatttgaatccattgtttaagtagctcatggttctccaacgcttcctcctcgtgacctaccctgcccagagtcacataaaccctgccctccaactcgccaagcgtctcatcgccatgggcgcgcacgtcaccattctcctcactctccacgtttaccgccgcatctccaacaaacccaccatccccggcctctccttcctccccttctccgacggctacgacgccggcttcgacgccctccacgccaccgactcggacttctttctctacgagtcccaactcaaacaccgcacctccgacttactctccaatctcatcctctccagcgccagcgagggccgccctttcacttgcctgctctacaccctcctccttccctgggttgctgacgtggcgcgccaattctacctccccacggcgttgctctggatcgaacccgccacggttttggatattctttatcacttctttcacggctacgccgatttcatcaacgacgaaaccaaagagaacattgtgcttccgggattgtcgttttcgctttcgccacgcgacgttccgtcgtttttgttgctgtggaaaccgagtgtgttttcttttactctcccgtcgtttgagaatcagattaaacaacttgacctagaaaccaacccaacggtgcttgtgaacacctttgaagctttggaagaagaagcgttgagggccattgataagatcaacatgatccccatcgggccgttgattccttctgcgttcttggacgggaatgacccaactgatacttcgtttggtggggacatttttcaagtctcaaatgattacgttgaatggcttgactcaaaggaagaggattcggtggtttacgtttcatttggtagctactttgagctttctaagagacaaatggaggaaattgcacgtgggttattagattgtggacgtccatttttgtgggtcgttagagaaaaggtaattaatggaaaaaaagaagaggaggaggagctttgttgtttcagagaggaattggagaagtgggggaagatagtgacatggtgttctcaggtggaggttctttcgcattcttctgtgggttgttttttaacacactgtgggtggaattcgaccatggaaagccttgtttctggggttccaatggtggcgtttcctcagtggactgatcagatgaccaatgcgaagctcatagaagatgtgtggaagataggggtgagagtggatcatcacgtgaacgcaaatgggatagttgaaggaaaggaaattgaggcatgtttggatgtggtgatggggagtggtgacagagcaagtgaatttagaaagaatgctaagaaatggaaggttttggctagggatgctgcgaaagaaggtggctcttcagagaagaatctgagggcatttgtggatgatgttagacaaaaatttatgcatacacatgtgggtgaatattaattaagttcgtctctaactagctagtagtaagctgtaatgtgttattgtatgcttatgatgcatggcttcaaacattgaaagatgaactgaaaaaattaagaaattataagtcagttaataaaaatgtgcgaaaatggaatatcttcaataataacatgtgcgtgttgctaaaaaatgagttgttgtcacgttagatggtggatgccatataactgtccaatatgttgcccaattcgtcaggaaaagataaatattttgataaagattattattacattgttgctttatactcccttcctttctttttatttgtattttaaaaaaatttatataaaaatcaagaaatataatcattttttcttgatcctcaaaagataattaattatgaaatttctcattttactcattttcatttctacactttccatcacatgtaaattaaataaaaattaggtgaaatgtaagcatgtatttgacaaaaaaatagttaatgccatttgataaataactaaaaatatttttttaaaaaaagttccacaattaaaaaggaaggaaaagagtatatttttatatagtatttaatctatttttttttcggtttctgaatttttcttcttcttagaaatgggaacttagatgaaacatattttgtaaaaagaaatctcttaattgaaaacctactaattaccttaattttaataacaaaaaatgataatttaaaacaaaaaatcgagtaattttttttaaaaatgattttcttttctctcttccccatttatctcctcgctctctattgagtaatcttttttaagatacaagaaacaaaagttgtcaaacaatttatatttcttgtttaaaaaaatcttagcttgatgaactaaatacaacttaattcattttataatcgtagatttgcattaaaattactaaaattatttaagaattatacaggtcggattagttggagttttaaaaaccaaaaatatgaaccaatcatttgatgcatgactcaacagttgaaagatgcgcaggaaagaagatcgatatatcaatcaatgaatccctacccttaatggcctattggagtaaagcgtacgtgtgagtgcgcggcgcctaacaattacgttggagctttgtggtacatatatgtacgagtttttctcgcatgttttttttttttttccaaggaattctcgcatgttttttatgcctatgattggtccgcaatttttaaggcaaggcaatatatgtgttgttcacaccgcccgtacattatcacaattatgatcaatcacaaatcacaaattcataaattatgatctatgaacatatataaacattaataaattaagtttgagacacgtgaattcaaagtattcttaaagatttatttacgtaataaataagcaagtcctcaatagtatattaataaacccatcctaataaatttttagtgagactaattcagaaactcacacaaagaaaaatgagaggatctggagagattaatatttaaaaaccttttgaaaagttatatttataatgaaagtcacttgagactaagttaagaattagatgagactccgtctaaaagtcaacaagattaagtctaagataattatttctttttatgagcaataaattatttttaaaaaatattttctaaattatttaatcacaggtattaaacctgttgaaatgtcaatcaaaatatacaacagtatgtgcatggattcttgatgacaataattccaaaaccacaaatatgtatttataatcatcttaaaagctctagtgagacacttagcggtacaaattaaattttttaaatcgttgggcaaagaatcatcagcaaatgtagtttttttttttttttgagaaatcacccaatgtattcaattgcggaagcaggagcttgtcattccagtagtccaatttttcagttatacttttgatttttatagggtaagtactaagtaacctagctagtttcttaatctcatgatctcttggcttatctttttttttttttaatttgtgcttgagtcactatacatatttacttggttgtcgaacaaaattaaaatttcttcgtacctaaacaaaacctaacttaaagtcccagactaattcaacaataatcaactcaatttttttttttttgcatgttacatttcatacattaactgttgagctactttatgggttccctcccgtgtagggtttgtttaatgatattagcttgaagttttcactcttttgatcttcaagaagagttaaaggtggacatgtctgtaggattgtcagcaatcttttcaaaaagtatccattctctatgtcaagcaattttttcagaaagtttccctacttgattgagggtagttttttcttaatactagctgagtgaaagaaggatatatatataatccaccggcagatttgggttctgttaagtgatcagttatttctaaatcaaaccagaaattgatcgaaggacatggaagctttagtggaaacaagaggagaaaatgagagaatttgctagctaggtggaaagctcaacatcgcattaatccttgtaatgaaggaagcacaaaactgctttcattgagctggtgtcaaactaaaggcaacttgaggctgaactcggtcgtgcggtcaagcaagacatttctgtgtacgtagctgtacaataatatacaatgaattagaataataacagattatgtggcattaattattacagcagcaactcattccttgattctgggaattagcaatttcttccagcttatatatataccagcatctcaatccttgattgtacgatataattttgcaatttgatccaaatttattacagctagttaggatactactcgtcttacaatttttgacaaggttttgtcagcaatgttgaggatgtttaagctgaacaccgtccgagaagtaaaatactattaaaggaggctaaaggaatatattggattagaattttaaaagattattttaatataaaaggttatatgaattttaaaaattatgtagaagtattatgacttattatatttttttacaaaatttttataatagttttaattttaataaatttatatgataagaatttaaaagacttaaatttttttaaaaaaatttataaaatttaaaagaattatatgaatttttaaaatcacattcaaaattacaataattaatgaagaaaataacaaaaaataatgagatttggataaaaaaagtaaaatcaaaacaatttttttaatctttcaataacatattgattctaactttatattctcctatattaacctttcatgcaataatatcttctcattcttacttttgaatttgaacaataaatttaaaattatacattgattttctgatttttttaattagtctaattatttcataataaatataatgacatgttatggaatgcaataataaatatatactaaaaaagagtaataagagtgtgaaattggtacgacagttattaagtcatgtggataatgaaattaagagtaacatttatgaaaatattatattgagcaagttataaacataatcactaaaactcatcataagaaaaaaaacatgattagtcttgacacataagataaacattaatttaatttaaaaaacaaagaaaaaagtgtagaggggagacatatatttgacattttttatttcaaaagaataagagaaatatatatggtgcttgcatcttgatgaacattaaatagataaaaagatatgtgtgataaaagaaaaaaaaaagtgtggtaatcaatagaaaaaaaaaagagaaaaatcattcaaatcattcaatagaaaagtgtggggttgtttaattgatgttttatattaaaaaattagatgaaattcatccaaatcattcttaaaaaataatgcatcaaaatttgtatatttttaaatattaaaagacttttttataagttataaaaaattataattgaataccaccaaattttattatttttcttaaaaaatcttaaatgttttaattgaataccataagacttttttatataaaaattattttaaaatcttttcaaatcttaatccaatatatccactaagttattaaaggctaggaggaaacaagtggaccatgagacaatacatatataggggggaatatatggaaattgaaaaaaaaaagatgtgaaaaataataaatctcaatagaaaatgaaggaagcataaatgaaataaaagtgaaatcaggtgatgagataaaaaacaattgtctaaaaaaattgacgataagtctataataaataaaaagtgaggtcatatacatattcccgatttctataaaaaaaaatgaatatttgaaaatcaattcattttcaatctttaaaaaataaataaaaaagaattgaagttgtatatcaatctatggagaattaattcaaaaaatgatttatagaagttagcaatagaaaaatacgtactaacattataagaaagagaaaatattttaagagataaatagcaaaataatatttatttaactgaatgagtatcttaaaccatatatcaaaatttacaacacattaaaatgaaaaatcttaaaaagaaggaacaacaaaactttttatgaaaattataaccaaaaaaaaataaaaattaatataaagcttaacatttcttttgttgaagtactaatataaagcttaacatgatagctaggataagcactatcctatggccacaataaataataaattatatcaaaatatgataattatcatattctatcaatgcatgattctcatctggtccatttcttaccaccaaacaaactttaagagttttgtttgattcgcaaaaaactataatacatatggaacatattaggatatggtaaaatttttttttattattcaaaaaatcacggataactttttgtttcaaatataaaatattaaaatagtatatatatcaatattgatatttctttaataaccaaaaatattaacttaacaatgtaattcttttaaaaaggaaacatcaaatttttaattctaatttctctcgttttattttggtaaacagatttaatttgatgtaaatcatattaacataattaatattaggtattttaataattttttattattttatttgtattgttcattatttgttgaataatatataagataaaaaacattttgtcatttatctttatcctatcttattttttatcttgtctaatatcatatttttaacaaatcaaatagggtgtaagtgtttgataaattttttcaaacaaattacaaatgttaatatattttattttttcaacaattaatatgttaatcttaataaacaaattcacattttatttttcatttaccaaaatagatatattatttttaaatattgtttgaaataaataatttataattaattaaaaaaaataataatttcatttcgtaacatatttttcacattgaaataaacatgtacgacacacatatatacatacatatatatatatatatatatatatatatatatatatatatatatatatatatatatatatatatatatattttggcagcacacataaatattatatccagcgaaaaaccaaagaaagactctttcttgtatcaaaagatcaattttcttttttgtccatagctcacctatttttcacccaatcagttttttttttatcactacaaaggggagactctttcttgcattaaaagttcacttttttttaaaaataattcatattaatataccaacttaagaaagctgttaaatatattaaaaaaaggaaatatgttattattaaatcaaattttcatcagttaacaaccaacattttaatctaatttagttgtttaaacaaaatttgtatgtattataaatttttaatattatttttatttttaaaaataaaaaacagtgaaaacaataaaccttgcattatcatatatagtcaattaaaaaaaaggaatgagtgaaggggaaaaagtggaggaaaaggtaatggattcaattccttccattaatattttaaacaaaaattaataaattaacatattggtaaaaaatataatattaatttcttgaaaatttgtatccagtagtacaacattataaattattttttaggtttaaatatgtttttgatttctttaaatcagtattttttatttttatctttgtaatttttttattgtttaaattattatttatcctgtcttatgaatgaagaataaaataattatattttatattttttttaaaaacaaaataaaaaaacaaaattgtagaaaaaaatatatttgagtttttattttatcatacgccactgtaaaccaatctaataaagtcagtaaccaaaacttggctagcacgcaggctgttttgtgtttagcccatgtaattatttgattttttataggttaaagtagatttcaaagtatgacacgacagcgtcttctcagcaaaaacaaaaaacactgcctcatccatctcttcgtgttccgttcttttactacagctttgctactactgtcttctacaaaccttcttccctctcttctccataacacttcccaccaacccaagttcaacacctctctctctctctctctcacacaaacacttctcccaaccctaatgtctctccccaaaaccctactttctctcttccttctcctcacgatccccctagtaaccgccgatgacgccgcggtgatgtcgaattttctcaaatccctcactccaccgccctcgggctggtctgaaacaaccccattctgccaatggaagggtatccaatgcgattcatccagccacgtgaccagcataagcctcgcttcgcattccctcaccggaacactcccctcggatctcaattccctctctcaactccgcactctctccctccaagacaattccctcaccggcaccctcccttctctctccaacctttctttcctccaaaccgtctacttaaaccgcaacaacttctcctccgtgtcccccaccgctttcgcctccctaacctccctccaaaccctcagcctcggctccaaccctgctctccaaccctggtccttccccaccgacctcacttcctcctctaacctaatcgacctcgacctcgccaccgtatccctcaccggtcccttgccggacattttcgacaaattcccttcccttcaacaccttcgcctctcttacaacaacctcaccggcaatttaccctcctctttctccgccgccaacaatctcgaaacgctctggctcaacaaccaggccgccggcttgtccggtaccctcctcgtcctctccaacatgtctgcattaaaccagtcctggctcaataagaaccagttcaccggttccataccggatttatcgcaatgcacggctttgtctgacttgcagctcagggataaccagttaactggtgtggttcccgcttcattgacaagtcttcctagtttgaagaaagtttctctggataataatgagcttcaggggcctgtgcccgtgtttgggaaaggtgtgaatgttactctcgatgggattaatagtttttgtcttgatactcctgggaattgtgatcccagggtgatggttttgctgcagattgccgaggcattcgggtatccaattcggttggcagagtcgtggaaggggaatgatccgtgtgatggttggaactatgttgtgtgtgctgccggaaagattattactgtcaatttcgagaaacagggtttgcagggtaccatctcccctgcatttgccaatttgactgacttgaggactttgtttctcaatggcaataatttgatcggttctatacctgatagtttgatcactttgcctcagcttcagactcttgatgtgtctgacaacaacctctctggattggttcctaagttcccaccaaaggtgaagttggtgactgcgggaaatgctttgcttgggaaaccccttagtcctggaggtggaccaagtggaactactccttctgggtcttcgaccggtggaagtggtggtgaatcctcaaagggtaattcttcggtgtcgccaggttggattgctggtatagttgttattgtgttgttttttattgcagtggtgttgtttgtgtcttggaagtgttttgtcaacaagctgcaggggaagttcagtagggttaaaggtcatgaaaatgggaaaggaggctttaaacttgatgctgtccatgtttctaatggatatggtggtgttccagttgagttgcaaagccagagcagtggtgatcgcagtgaccttcatgctttagatggtccaacattttctatccaagttcttcgacaagtgacgaataatttcagcgaggagaacattttaggcaggggagggtttggagtagtttataagggggtgttgcatgatggaacaaaaattgctgttaagaggatggaatctgttgcaatggggaacaaaggtcagaaagagttcgaagcagagattgcacttcttagtaaagttaggcatagacatttggttgctcttctagggtattgcatcaatggcaatgaaaggcttttggtgtatgagtatatgcctcaaggtacattaacacagcacctgtttgagtggcaggagcatgggtatgctcctttgacttggaagcaaagggtagtaatagctttggatgtagcgcggggggtggaatacttgcacagtttagctcagcaaagcttcattcatagagacttaaaaccctcaaacatactactaggcgatgacatgagagcaaaggttgctgattttgggttggttaaaaatgcaccagatgggaagtattctgttgagacacggttggctggaacatttggatatcttgcacctgagtatgcaggtacagaaagcctttgattttagttttgtacaattgtgccttaattttgaagttcatattttatatgctcgtatttggtggttatagctgttggttattacttcaatatcatgcttcggtgttcagcaaatttaagtagttcaccagagtaatcgctcacatacaaaaaaaaagtagaaagagttgaagggaaaataattgatactcaattcctagatacatggctacttcaaaattctttgtggctatttctttgcaatgttatattttgctcttttcacgtgttttgttgagttgggtgggggttttgctgcatagttcttggtggttgatgcctcaaaagatatgtcgagccatttttagacagtttaccagagtctgactctcaattatcctttacgatgtgatgaatactctggttgcattaaatctttgattgctgtatattgtcatgggcttaggtggtagttctctgtcgcaactaatcactgttgtggaatttatcattctatcccatttccttgttggatcggtgcattgaaacatcttttgttaaaactgttattttgatcggtgttgtttttatccatttagcatcaagacttttgcaagcataaaacttcctaaaatgttgcattgaatgtgattagatggcatttgattagtgctagtctatttgtttgattatatttaatgttactctgtttcttaccagctactggaagagtgacaaccaaagtggatgtttatgcatttggagtagttctgatggaacttatcaccggtagaaaggcattggatgatactgtgccagatgaaaggtctcacttggtgacatggttccgtagggtactaattaacaaggaaaacattccaaaggcaattgatcaaattctcaatccagatgaggaaaccatgggaagcatatatacagtggccgagctggcaggccattgcactgctcgcgaaccataccaaaggccggatatgggtcatgcagtgaacgtcttggttcctcttgtggagcaatggaaacctactagccatgatgaagaagaggaagacggctctggcggtgaccttcatatgagccttcctcaagctctacgaaggtggcaagccaacgaaggcacttcctcaatatttaatgacatttccatctcacaaacccaatcaagcatctcctctaaacctgcagggtttgcagactcctttgattcaatggattgccgttaaccgaattgataaacgagacaactatccaagggcatcttagtccatatgatagtggaaggtttagttgagaatacccaagaaaaccagaggttgtaaagctgttttgatctattagcatcgccaatttctttgtaattatttattattgttcaaaatgtcatttttatggtgttcttaaaatctcctcatctgaactaaacctggatcttttagtttggcgttctttattgattctttaagacgatggatgggttttaaaggatggttattggtcggtgtacctgatcgtgaggatgattattttattttatttttgggaagggaaggactatacatttattaattgtattatattcttttttatccctttttgaatcagaagtatatttatcgcatgtgccataaactttcttctgtgcccgttatgcatctgtgtcaactctccatccacctataaggtctagtgtgtgtataaatcatttccactcgacaccttacaaataaatggagcaatatgttcgctgttcaaatgaataatgagaccacctgcccggaatttatgatgtgtagttaggaaactttgaaacacactttgttggatatacgaaacgaaatctacaaatttttttaagcaattgagttggatgaggtggttagatagtctttatgtaaatactagtagttccaatatttaaatccttaacatggttggtaaagtctagataaggttttatacctccattttggaactaaaatcaagccttttatccttaccttacctttcggggaggaagcaccacttgaacaatcatctaattggtggcgatagaaagagatatggaaatatactgaataaaaagaatttttttaaaaatacataaatacattgtggtgattcaaagttctgaataaatttaattttttgaaaatggatacataatcttaaaatttgggttggtgatgggatggttttaatttcacacgatgagcctatacaatacgtgaccgcacatatggggattcaaagctcagcagatggatatataactttcgcaacaaagcacatgctaatggttatgggtactgattcatgttttctttattgtggttacgtatgccgtatccatgttaagttgcccaccacattctagatgcgttttatacctattgccaaaaatatagggcagattgagcagttgaaaataattgaattggcaatgataatagagattcaattatatgaaagagaattcgtaagtaggaaaattccaattgttagattagttggttaccttttaatttattgtgcctgctggttttttataagaacgtgaacatcaggttacacaacaagtgtggaatgtcatgtgcttagggtcagtggaggatcgatggatcctccaaatttcaattgcaattagtacttagtaggcaacaagatggctcactcaggaagatattattggatggactatgctccctgtttcaccatataaaatagagtttgactcttttaatatcaccgcttagtgtattgttatcatagcataagttaattggtatactattaacgaccgctaatgatatcaatcaaggaataatacgatggtgggtaaaaatttcagctgcttcatctctgccagacacaagcaagagccatacaataactacatctagagagtgaatagaacaaagctcttaaacgtgaacgacacgttgttgctggctagagcttatattgcagatgccatattcattttcccggcaataatttttagagttgttcaaattttgatttagaagtcattaatttttttactaatgaccataaattatatattttcaatgattcacttgttttttccttcttttttctttttagaagcaataattccattatttgatcgagagcattttcgatgcgaatgctcatatgagttatttaattttaaataaagtcatgtgttttgatgggagaatttaaaattctgagaaattttaaattctaaaaattttaaatacttcaattgaaattcttttattttcaaaattttgtgtttagataaaaaataaataaattatgagggtgaaaaaaatgaatgaaaaaaaagaagatatgattggtgtgttagttatacgtactttcctcgattaaaattctctatccaaacacactttaagtttttttttttccatatgaatatgaagtgaagttatttatataaacattgttgcttatacaaacaattgtttaataatattataccataaataacatttttatgtataataaaatttataaaattaatttaaatgcgcgctttaacaatattattatttaaataaatttttgtttaaaatgcttaaatctatacgaaattataagatccacaaaattataataaacaactatacatcatacacactctaatgagcttagtttatttttcgtttgagaggccttattattgatttcaaactaaagctatcaacgcaagttattgtattggaagtaggaaaaaaaatgacaaaaaggaattgacaaaacaaattcaacataccaagaatcgatgtttcattctgcatttataatgcctacaaatcaagctatggtaaatggcatcaagatttgtaagagaaaacttcttggctctatatttaagaacaaaaaatctaagagaaaatgggattgaatggaaatgatcggtcgcaagcatatctaaatttgacaggaaatccataaatgacttgaccaccattaacaagataaatattgtgtgagatctttaaaagtgaagattttacgggtttaacagattaaaaacttttacaatttaatatcacattcttttgaacacatgaacacttattgatgatagttacattccatgcttgctttccttgcactttattttttgttggaaattgatctacggagagatctttcaaggaacattggctatagctgacatgatgatagaaggaaaaattacaaacaataatttatacaaattttatgtttcatacaatagaagaaaccagtatcttgacttcttgagaaatgaggacaaggagcaaaactatgctaagaatcttgatggctgaaccagccatttcagaaaatgtaaatacaagcttcgattctcgaattgcatagctcttatatgtcgcgttatttataaatgaattgttgtaatttgtaaaacaatatgttttacgtttcgtgtgaagaatatcacatttatgaatgactgaatttttaagacaatgaaactgaagttaaagaaacataaattactctaaaaaaaattaaatacagtgaaattgtatagatttgataaatatttttttaatagttgatatgattttgttttgttaggagaaagctatcattttgttctcctatagttatgtttagtaagttattttaattaaatttttttattaattaaaagatttatttgactatttgataaataatttttttaagtaatttttaatgtttctctagtatcttttagtatttttttaaaatattatttaaaataacattttttaaacactaatttttaatttttaaccttttaattttattctctttatatcttaaaatatttattcaatttatttattacattttttaaatgttacttatatcattttatcttttctaattaattcaacaaatattttcaatgaacacttataatttaataaaactcaaaagtttttaaatattcactttcaacttttgattataattactaactaattttttaactatttgagccaactttttaacttttcagtttacttttgcaaataacatatttctttcctggcatatgacaaagctaaacaatatttcttgagtgtttaattgttttaaattgaaataggaagtgagcatttactaatatcttagctcgaaacatctctttcatctttgttgaagtaaacctctgtatggtaaaattaagaggagaaagaaaaatgaagtggagtaaggtcttgtttgaaattattttttaatttcaaaacttgttttcaatataatttttagctttgttatattttaaaaataaaataaaaagaaaaaatatttgttaaaattcaaaaatagattttttttaaaaaaatgttcataaaatatcagcatctgtcaattgcatgtttatgaggtaaaaaattgctttatttatgaaaatatttaggatccaaaacaagagtaggaaagtaatttttaaaagacatttttttccagcactgcaattgtaggaacaagttttaaaatacaaatgccttgaaaatctttctaatacttaatggaaaatattaaataaaaataaaaataaaaataaaaatatttaatgttttaaaaactttaaaaacattcaaatactttctttatttaataagaggaggatgaagggattagaattattcaatttttttatattaaaatataacgaatccataacaaatttacagtagtactttgtttcataaaaaaatactgattggatgaagcagagaggagagaggaagatgtcagtaagtcataaatgtgccattaatacatttaataactttttttttttacaaaagggagaaaggcttacatttaaattgctattactttttttaaacgaaaaaggggtgaaacgcccaaaataaatcatcataaataagataataagataaggaaggagaaaataaatttaaatattgatcacaaataaattttgcataaatacaaataaaatataagataataaatatcgatcaattcgtgaaacaatttgcggaagagcaaaatttgagaaaaaaaatcgaagaaacaaaattcgcgatattataaaactttagagataaaaaaaaattcatgataaataatacagtatattataattttaatctttagtttttaatacaactgtaaaaaaaattcatgataaataatatattataattataatctttagttttaattgaaccaaatgacatcatataagctagtgatatttgatcaaactagtttataaactctcctagtctttccaaaaaacactttgttgaagttgtactttccatgaagagcatccttaccaagttattatacattactaacattagagaatttgttgcaagaactttttgttagtaacagaaagtgtaaactggtttggagaaaatgtgagagatggcaggatactatgagtaactagttggattggaaaatgttgtatccagctgtaaattacccattccattattggaaggaaatattccgcatgagccaaactatgcgaaaatgacatggtgaaaattgataaaggtaaagaaaaagtggagctcagaaaggtgttattcttcatcaagaagagctatttccaaagcaactatattacttgtgcaactctttattttttgtacatatactactattattattacttgtgctactctgataaatagaaagtagaaaacaaagaagtggtattgattgatgttacgtaagttacataaaagtttgatgcgtattgattgatgcattaataaaataaaaaaaagtttgatgcatattgtaatttactaccatagtcataaactgtgataggcaagcatggcttatatgattgcagcctctgcattcattccaatggctcaaattttataagcttatagtattttattaactttttaacgtgggaaaaaaacggcatagattctcctttttgcattcgctatgtgattctaaggaatccaatttcaaggaaaatgtagtgcatgaaaataacaaagaattatgttattcatgtgccattttgagatgtacaagatgaaaagagaaagagaatgaaatatttatcctctgaattttttggttgaaaatgaaaacaattcatttggagtgtaggttgtggccgatccatttacagatcatgcaaaactgtaaccgtaaatttcaaaattgtcatactcatgtacttttttttttctcttttgagggcggtccaaatagggaccagattctctgcagcaccctgcaatccttatccaactgttcaaaattttttaagctgtatttctatttattattaaatataaattattttacatggacaggatccaaatcagacaactttcttgagattacacaacctctcattttcttattttctatgcttagaattttctcaccggcaattttctcactcggtgccttgggctattagacagtaattatttgtgattgtgggtgattttaaaagtagttgaaggttaaattaggaataataaatgtgtacacgaaattaaatgggataattgtctttattaatagttataaataataatcagtatccatagtaactaattgttgcaattaaaaatgtagcatctcaaaccggaactgatggaagccttgtatctgaagagggttccacacacaaagcatcagacccttttgatattggaggtggacacgtggaccccaacaaagcaatggatccaggactcatatatgatatcaccactgaggattatgtccaattcctatgttccatggatcacagtagtgcatccattagcaaagtgactaagaccaccacaagttgtaagaaaggaaatcaccaagcactgaacctcaaccttccttccatatcagtgccaaacctgaagagggctgcaacagtaatgagaacagtgacaaacgtgggaaatattactgcagtctacaaagctctagtgaaagttccacatggcataaaagttagagttgaacctcaaactttgagtttcaattcagatgtacgaatccttaactttagtgtcagttttctgtcaactcaaaaatttcatggagattacaaatttgggagcctaacatggacagatggcaagtattttgtgaggaccccaatagctgtgaggaccatactgtttgaatgaataataagcggattttatatgaagaaatgagcttgattggtcaacaaactatgtaagttcttgtttggagtcatactaaacatagcatattctttggtgagaacatgcagcgtatattctttgaggaaagaaaactttttctttttcttttttttactgaggaaagaaaacttttttttttcttttttactgcttgaggaaagaaaattaattactaatgaaatatactgttcatttttaagattaaaaacgtttcttgattgcaactaacaataacttaatctattattttcaaaggagaaagtattgtactgcatttttcaatattcttttcaactttgtttagttgaaatttatatgaattatactaattttggaacgaatctcattaaatgaagaaagaaacccacatatttaacaagacttaaatcaattatgctcgataaaaaaagaatatatgaaacaagaatatcaaagactgttgtgttaatattttttctttttaaaatacagatggaagtacaagaataaaaagtggttcaacttccatgaataaaaatggtctttacatgatttgcacttaatctaaataaccaagcacaaaatatatcaaacttgtgtatattttcagtttagtattaattattaatgactagcaatagaatttagatttatagagacaatacagttagtaaattttattttagaaattattttaaaatattctaataattaaattactcttttgtttttacattgcaagtgcaagcatctacgtgcaaaaggagggtacgatactcaacaatagataaatttgcacaacatcatcagtctttgttcttctttttcttttttactttagatacgtaaggcagtaacaacatacgaattattaaaaagacagttagcgaagttaaaaattataataaattctgtttacttccgttcctttacaatgtaactcacaatcaaggttaatggagttctgttccattcccttattattcttccagacaaaagataagagaaacaagcttacattactacaacgttataagaagcaaataacctacgaagaaaatcaagataaataaatagatggtacaaatttgcatgtgttcggatatccatcgacatcattcatttcgatcaaaattcacgttttggacataaaagcaattcttcgtcgcttcagataatgcgtgtcgtggagcagaggatgcaaaaccatacatgcagaaaattatgcttgcagaatgacacttacgatggagcaccaagatatgaggcaagtcgtaaaatatcactaaatattccaccagcggtgacttgagcaccagctcctggcccacgaactatcagaggctgatccttataccttcgtgttgtaaatgcaataatgttatctgacccagacaattgcgcaaagggatgatccttcttgtatcttcgcagctctaccactccttttttattagtcacgtccaccactccaacgtatctcaagaccttcagagtgcaaatataacaatctcagagttgtgtggaagacatgaaaaatatacgtatttaatggacatgataatatacatatatgagacgtcatcatgaaaaatatacgtttatatagtccaggacacaaacaggagaccacaaggcaaacccaacataaatcaattgtcatacttttacttgaaatcaaggtttatatggaaatttaggtaacttgaaatatataataaccaactgaagatttgatatgcaaaactttgatgttttggtatgtcatcagtctaatcagaaaattcctagcccacctgctgcgtctcaaaataagtacgctatatgtttgtgtcatgcactatgcagaattaaaataaatatataacaaactaagggtgcctaatttgtaaggaatttttttattttccttttctgttttcactaaaaattataaaatgcccccttttcaacattacatgtacatatgaaaataaagtagcagtttttttaatttgtatggaaacaaaacaaaccctaagatattctatgcatgaattatgcatgtatgaagcagttggtagaactattttattagatagagttcactcacttccccagcattctcagcatcttcttgtttctttgtgaactcctgatcaaattttggtagctcttgcataaactcctgagctgatgcacaagcctgcacagaatcatcaaaacatctatgtcaatcaaaatactgcatactaaaactaaaaactgcataatcaatggaagttggttcttactcgtagtggttctggcacaaggctttcaactggaatattagacagttctagctttaaacccgactccctagcaagaattataacctgtagaggcaaagcagcttcaggatgtcaaatataaaccagattacatgaagcatgaatatgataacatgaacgaagattgacattgtgattagcctacacgttccaattagttgcagaaacaagcaagccttccaattagttacaacaacaaccaaacattttcctactaagtggggtcaactgcatatgtatttcacaataaataaataaaaaatacttaccaatatatttatttatttctacattttaaatttaaaattaggacatttgctcaacacaaattgtgtattggcaccaaagaggactattgataatattaataatatttcaattgtgtataggcacaaaagagaaatattaataatattatcaacttttgatttgtgtttttaaataattaaaatgctttcagcatcccaaccattaaaaatatcaaatttgagcatgaatcaaaatactcgataaccggataggtagatgtagatcaaatttaaattctagccagaaaccaaattcaagcttcaaaatgtttgatcaaatcaatctcaaacatctaaatatttaatttggatatagtcttttagatcatttaaattacagcctactcataaatcctaaacgaaattgaaattcaaaatatgtatgcagcataaaggaactttattaacatttgacaataaaatttggtaaacatataccatattataaattctacctttctggcaacatctgttccagacagatcatctcttggatctggctcagtataacctgcttcctttgcttcagaaactacctcactaaaagcccggccatctttaaagttattaaatatgtaactcaaagtcccactgcagagtcagaggcaatgctcatggtgaatggttgagattaatgaataatccctatataatcattaataatcctcaaaataacattctaattattttgtctttagaatgggaaaattgctagagggtggacaaatgagactgaacgcaagatctgagaattgacagtgtcaaaacacaaattaagacaaaaaagagaaataacacatcaaagcaaacctaaagatgccttcgatttgtaatattttgtctccagtttcaaggaggccacgtaaagtgctaacaattggaagaccagctccgacagttgcttcatagaagtaatgtgtataggattgcctttgaagagctcttaacttcaaatactggatatagagagcatagatgggaaaaagctccaacattagtagtaagtagactagagagtaaccaacatagcatgagtactagcaagcaacaactgctgaagcttaaataaaacagtttcaaaattatgaaaaatattattaaaacatgtcttcaaagtacttgttctatcagaaagcatgaacccaaagccaacacctactgttgttcagcgttccagtttatgctaaccataaagtttgatcgtagatgttaataactaaactatgaaacatcacttggtgtaaaagcaataaatttccaaattgctaaatataatggaagatgacaagagaacaagtagcagactggttgacatcaagtgacaagcttatacttataaatcattcctttttattctcagattaattatttgaattcctcattcctcagcatgagatcctgttagaacaattgtgccactagtcaacagagttcagtgaacctcggtttagagagagagtaacagagaaaagagtgagaaaattgtttaaaactgaaatgatgcattgagtcattaattttattggttccatagtcttgtatagtgaactttagcttgcgcttcaataaccagccgatcactttgaaatttagcctaactgaataccacgctgagtctgactcagctaactacaggttagtgacagctgtataactgctggacgataaaattacagttacagttactcttgctgataaaaaaaaaattacagttactctagtactagcaaatatgatagctgcaaaacagacaaagaaattcaaaagatgatattttgattttaaaaaagaaaagagaaaaaaaaatagacagctgccagtggatggtggtatgaagtaaatgatagaaataagagtaaaagctgactatccaaactccctaatattgataatgtgatgatgtgtattctcctttcctttaaatgaattattctttaatttataaaaaaacaaaacaaataaaaaattagaaaataaatcaatccaaattaatgtcttggaatttccattttcaaccgagtacttgcagaaaaaaacaggtttgtagtatcaaaatcctacagcattgataatacgagataagtcaacaaacacgaacatgttatccatcaaaagaacagtatggattactttacctgatcaagtggtcctgaatttgccttcttgttaggagtaactacatgtattcctttgcgcaaccaatcatagtaatagccagcaatgacagagtcagctgtgcagtccactaatgccgtgtttggtataaaatgatttccatgtacatgttgaacaaatttttccatattagccacttctcctctttcctctcgaagttctctccatctagctaagtcaatgcccctgcaaggagaaataatattatataatgattgaacaaaaaccaacttcaataatgcacatataaccaagctcataaaaccaacaaatcataggatgaattttgttgatgtatcttcatgaccactgtattaaccaatgaattcctcttgccaacagatgaacttcaaaattgtaagcaagagagagttgtcaaaccaaagtaggaagtccaaaaatcacccatatcaagaaacacggctcccaaaagcaatcaggtattgcctacattttgagtccattctatctaggagacccaatcacgttactatggcttacttaaaaatataatcttctttcatccaaataacaatacataaatgatatataataaacaataaagctttccaaaaaggtaaaaagactgaagtgtaaaatgaagtctgctttctcacataaaagggctctaatagttatacaagcaagaaagcctaattatcattcgaagagatatttcagtcagagtgattcaacttacacatcactaagaagcattgactttgaaccaagtatgcccattacacgcaaatcgatgttgaattcttcttttagggttgaggcctgcattaaaagaattgtcatgtgaatttgccacatatttcaattccagtatgttaacatgataaaatgaagttaccctactatagcataacaggaacatatttaaacacggaaatgtaaaatgcttgccagggatcaaatcataaagaaatatttaccagtcaaaaaagtcagaaatggagatgcataacaatgttaaagttagacaagtaaataccccatataaaatatttactagaattctagagagagagaggctgaatctgttttctgttattgattgatgaatcacttattactatctgatggaagatgagttttatataatagagttaccttgtcctgcaagcttacaatagaaacttcagctgcctacagctattaagactaactaaacttcagttaagccaatattaattgtgttttactatttaagtcctagtttacaatttctcctatatttttatttccattacttgtttcgaaagcaatcatctgaattttctctatcttcttgtataatgataagaaccttgggagatctacaccacaaaaactagtcattgtagtttggagagccaaggaccttatacatcctaaacttcaaatgtgagactcaagtctcataccttgcaattggatcctaacattccatcttgctttgcagccacgggcccacacgagcaggctgtgcactaaccctttaactagtcccaagcaaaaactacaatgccagcatcaccacccatgccgctcatttgtagttgagaaacacagtggaaatatctgatatcaattagataagaaccttggaagaaccacacaacaaaaagtagtcatggtagttggagaccccaaagtcgtatatataaacactacactagaatgtcacacttccaatgtggtggcaccttttttacttacattgacaaacaaataaattcttttgaaaatgtattttaatcagtaaaacagttacaaatggtgcagcttcaacataaagaaaattatctgttattaaaataaactttattcttcaattataggcattatttccttgaagaggaattttaaattagaaaaatagttaatttcacaccaaggatgatgacaggcaaaatacacaccaaaacataaaaaaggtaaaaccaaaataattattcaggcatacaaaaagtgtctacagaaactgcacctgatcccttagctgctcaagtagtgtgctcccaattaatccaggtccaataatgcccattgctatggtggttcttgagagataaaatctggaatggacagctcgtaaagcctttatacaatcctctcgcttaacaacaacagtaatattgtactcagaacaaccttgggctatagcacggacatttatattggcctgtttatgaaaacaagtttgaacataaaacaagcaaaagaatatacaaaatacgcaaaaatctctaacctaagcaatatcttaaacataatttcctaaccttagccaatgcattgaaaagggaggcactaacaccaggagtgcttgccattttctggccaactgcagccagaatgctacaatttggaatgactgcaacctgagagatgattcataacttagaatccaaaaaaggtaataaaataacaagctttaaattttaacatcattcagtcacatactaatttaaacagaagaaatgaaattattcggctctcaagtttctacttcatgataataaacaaacaaaagaaataagcacataaactgatgggaaaaaaagaagaggaagaagcactccatttaacacaactttcacgtccaactatcttatgaggaagagactatgcatttccttttgattatcaaatacattattgccacattcacagaacaaaaaagtggcatatccctagttaatattttattgaattatatcatgaacatccttacattcaagaatcaaatacaacaattggtgaacaaattcaaaggtaacacccaaatttttgtgataagcgagcaaacataactcaatacaattcaaccatgacttctacaggcataatgcactattgttccaggaagactcaaggctcgagccttaatgttattggatgacttcatctttggaactttaaagaagttcccaatggatccttgtgcttgacattttatagtaatccttgatttttatattaatctagtgcaagaaataatagtcttagtcccaactgttgatatctgcatcactgatgtttgcttccactgttctagatcataataattattaagtggactgtagcttgcatatttcttttaaccctaatatgcacttattattaattaaaattaagaggaaaattaaaacactttcacaatgaagacaaattgtatagaaaagataatacaacacttcagtctttatactcttaaaaaaattaagagcatggaaccatggttttgaattgaggtctgcaaccacaattgcagccgcaacataaaagttttttgactcatgacagccacatcgtgaccacaattgcagcagccacatcagcccgcaacataaaaaatcacaacgaaactgcaactgcaatttacaaccatgcatggcactcaaatatttcatccagttttcaaatccacaaaatgtagaatgataaatcttcagtctgatatcactaaagagagtcaagtcttaacaattgaacagaaacatgcatttggttttagaagaattggatttagcacctgagaaagacgcccattatccaaagcttgacgaaatctagattgcaatgcctcagcaacagcttttacttctttctcgggcacagcaaagcatacagaatgctcactactagcctacataaatactgttaatgattaatgccatttcttatatatcagcgtggacaactagaaaaattgaaaaaagttataagtgcacctgagatatcatgataacattagctccaacatcttttactgcaccaaaaatagcactggcagtacctggaacaccagccattccagttctgcaaaaaagcatcaaagaaaaatttattggaatctacaacttggacaattaatattggttaaagaaaaccttaaattaaatagaaatcctcgtgcagcaaaaaatgccaactattcatcatgtaacacaactgcaattcatgactcacccctcgacgtttacaagtgccaagttgtctatggttgcaaatcctttgacaaaattttgcaggttctggctatcttcatgatcattaacagaaggatggcagatctttgttccaggagcagaaaggttgaaaatgttccttatcataatgggtatgccatatcgcatcacaggaataattgtgcggggatgcaagacattggcaccaaaataagactgtacaacagacaatttgcaagttaatctccttaattttacaagcagaaggagcattgaggctttccagcatctaactcaccatttcccaagcctcttgataagacagtgtcttcaaaatcacagcctcactaactgcataagatattattgtttatatttaatcaaaacatcatgttatggcagtcaaacacaacacaaaagaatcatcaatatgtcagagctagaactccctctggttactaaaaaccaattctcatgatccagtccactcattgtttaactcagagacagagtacgaagcataacaaaccttttctaggatctgcactatacacaccatcaacatctgtccaaattgtgacctgacgagccttaaatagagcacccataattgctgccgagaagtcacttccatctctcttcagtgtggtaggaatgttttgaggtgtgcttgcaatgaatccagtggcaatgattaccttacatggattcaaagagtaccatttttcaagtctttgctcagattccaaatagtcaggatcaacttgattagaaccagtaggatttacgataaggacatcccttgtatccatccatttgcaatcagtcccattctgtagaaccggaacagaagcatgatgcaatgagctaaattcagataaagggggaaaaagcatatctttctaaataaaacagcataccttcctaataactagagacaacatctgagcagaccataattctccatgtcccacaacaaaatctgtaaaggactctgttgcatgaccagctgcaagatattaagagtgttagttaggcttaaaatgcaattccttaactcattcattttaagcaacaacatttacggaaaactaaatatcattcattgtggaaaaggtgtttacagagatcatactatgaaattatgggaaaaggtgattaagcatagattaagagaagtgactggaattgtttgatttttgagacatgaagaaacatgcataatacaggtcatgtgaccaatttcatgtgtgctacaggtcatctaaccaattgcatgtatactacggttatgcgatcagttacatgtatactacagatcatgtgacattaatgaccaaaaagtaccatatattattattattattattattgtcatacaatggtgtccaagacataagcaacgatcaatattacaaaatagcaaccaagaaatagataatgcaatatacatcaacatcaatactattacaatgtgaaaacaacaccagaaagtgaaagccataaatgccaacttatgtctaaacaaggacgacgtgaaaataacatcctaggttcaaatgaggatttataaaagaaatagatataactgaacaagagaaaacaaaataataaattaatacataaattaaataggtttttagtaccaaaaaaaaggaacagagtatcaaagagaaagcgagggttgacgagcttataacctatgtatattgcacgaagcatcgccttaaggttactaatatcatgatgcaatttagacaagaaagtagcaagattatctccatcaagtatgtcatgtgcagttgcactgtgcttctccaaaacagcatttaatgcagctgtataagactcatcgcgtgattgagccttgtggataaggtcatacatcatatctgtcacctttgacattgcagaaacaaccaccaatttcctctccgaatcatccttaagaattatgtccgcaacattttttattctctgagaggttcccacacaggttccaccaaatttgtgaacagaccaagtttctcctttgggtagttgtttttcctccaaggacacattcggtgaaacatctgctagcaaatatagaaaggacaaaaaaacataagttactgtatttgtctattagagttctaaggttgacttgatggtaaaaggagaagggagagagggaaaggtcgtgggtgggttcaattttctccgctaacaaaaaactaacaattaacaactaatatttgctgataataaaaaaaactgtattcgtctatttcaaaacataaccataagagtaagtcgtaacctgtaaatgaagcacgtacagatgtactcggtgcctctcttccccgtggtaaagtaagacccttcctgagacagaaaccattgtatcgtcgtgaatcagtatatagcaaaacacaaaaatccaattaatctcatggggagaatatcatttaaactgccaaaattccgaaaacactctaatctctgcaaaggataaatatacaaaaaggaaaaaaaaaagtacagaatatactgcttgtagaacaaccaatcatctaagagattatttagcacatatctgccaaatatacgatgtttacaactttcgttaatttgcaattatagtcttaatattcaaactgagggaatatactctcaaattctccattcaactgataagcatattaatcaaacatcaggtttcatatcagatacttgctctctcttctctgcttattcctttcttttaagagcaaaaaaaagaatcaaaaacagtaaagtcgcatctcgtccaagtgttcaagcaaaacacaatagcaagcaactagctgttgtatgtgtggtcaaagatagaaaatcagagacatggagctacacaagcattggtgtaatttgatccaaaaccaaatgcgaaaaggatcgaggaaacaacagtgattcgcgaaacctagttgtggaaaggaacgtaccggagtgaatgggaagtgcgcgagaggaagaaagggcggcattgagattggaagagcgtgccgtgagagtgagagtggagcgaagtgtgagaaggtgaaacgcgggagaactgagcgacggcggcggaaaacgacgccatgggtggtggctgctgctgcagagtaaaatgctccacggaaacgaagtgaaacgacgagtgagtgtaactttataaactacaatcgattattactattgtcgtgctcctagggatgcaaatgcggctgccgatacagtactttcctggtggcatttctaataggttaaagtaaaaattcattacatttgctatttagtccctcacatattacactatgggtccgttcggttataactttttaattcttatattaaatatattatctttaaaagactactgatgaggataaatacataaaaaaaaatagttattttaccatctaaaaacattgttccattgagtacacttcaaatttagagaaaggaaaattgagttgaaataatgaaatgaaatggatcataatccatcatcatcttccattatgtttcatttcaacttttacaaatcaaacaatccaacaccttttccttccactccatccttcttcattccatactctacaaccaatcaaaacatattcgaaggtttccatgtatgtagaattataaataggttgaacaaaattttattgggtaggttgaaaagaattatttggtactattattcgtacgcccctaaccatgtgtttggatgaagaatttaaaaatttctaagaaatttaaattcataacattttaattgccttgattttaattcctttccttttgtaaatattttgtttggatgaggtaattcaaattcttgtattttaattttcttctttggacaaagtgattcaatttcaataaaattcaaattttcatttttaaatatttatttaaaaattaaaatttcaatattcaatgaaaataaacaagagcccaacaaggtaggcctcagtccttgggcataatggcaactctcttgggtgaatggtgcagaggttggtgtcctcgaagagcacaacgaggtaggcctctgcggcttcttggagagtggagacggcgctgctgtggaagtagagattggtcttgaagtcctgagcgatttcccttacgagtctttggaaaggaagcttccttatgagaagctcggtgttcttctggtacttttggatctcccttagcgccaccgtacttggcctgaaatggtgcggcttcttcacgccgccggtcggcggagcggacttgtgtgttgctttcgtggcaagttgctttctcaaagcttttcctctagtggacttccttgcggtttgcttcatacgagccatttcgaacacagagattgcttgactttggaagaagactaatgagtacagcacggtgtgagtacgaacacgttttgagaaattcaaattcctagatttttaggagaatttcatatgactcagttttggttaattaaaattctctattaaaattccaggtatttaatttcttcttaaattattatccaaacactaaatttaaaatgacagtaatttaatatctcatttaaaatgaattgctcagatgaaagtattcatccaaacacactctaaatgtttacaattatggctatgagaaattctagtaacattatttaacaaattctgtttaattaaaaattattaattttgatgtatcctattttttatttataatttttttctgatttaatagtgaaatctaaaattgatcatttctaataaattttcacaatcatgaaagtttgattataatattatgaagaaaaagttgaagaagatattatgtttgtagttgtattaatatctttaattcttaatagtattgtacttttttggtgtttaataattttggggtggggggagatgacccttaatcaaaggcatgaaaaagcttttgagatgattgtacttgaagaagcaatttatctcattcaaaagagacaaataaaaatgttaattacattagtttttgttgttaactttattatgaactacttttttatgattgggaaataaagacaccaacaatgaagattgaaatttgaaaccaaaagcaaaaactacatcctagtatgagaaacaccattggcatcagctgacagcatgtgcttcatttgactaggacaagactccaaaacataaagaagtcgacaaggactctattatataaactaataatgacaataaatcataagctttaggaattataatgataacaaattgtacatattatagactaaaatgacaataattttaatctaaacaatttatttatatttttttaattttatgatgtgttaaattgtgacagtgccctacaattttaaagaacgtacaaaataattatttattcaaaattttaaacataacattacctttccctacaacgtccccccgatagtgtcatcagtaggactcttgcttcagaacaaaacgcgagtccatataaggcaactgcaatttttttaattagtcttccgtttgtttcgggggctaatggggaattatagcaagtgtgagaattttctatgcttttaaactaaaatctacatatttataaaaatataaaagtaaaaaaaaaatgccacggatagttcagtcaaagataattcgaaatcatagtaaatattaaatgattggattttacaacatctatttgaaagagtcatcataaaacttaataccacactttaaccaaaaactttaaaagtcaactttatgattttttttctcactcaacttttatatttttcttgatacgaaatcttaccttacacttctattccaatatgaatgggcaaaacacacttatagttttgatttccaagttctagaatttgcttcagattgtattctcaatactttaaggttggattccaatcctattatgttacccaagatgtcgtaagttctctaggtggttttttcgaaacaaaaaaaatttatttgtaataaaataaataatattacttcattctcatgtctttttatatttaaggttattattaagaaatatttgatgaaaataaacattgttcaccctcgtagcctccgttatggcgagagtgcctctcatttgcgttccaaacagccctagcttacaccataatgggttgtgtcaccctcgtagccttccttgcattctcattatcataaacgacgccgctttgggagacgccttccatgtctatgccacccttcagagcataggccccaccatcttgagcttgtgggttgtcggactagggccgctctctaaagtcaccaccgctgtagcggtggcgctcgccgcgtttgtggtggttctttcctggcctcagagcacaaatttgatagctaaacgcatatcattgggtcagatagtaccaccatgttgaaattaagaggaaagaagttttaaaaaccctaatttgaggaagaagaagcaagtgaagaagaaaatatttgacaactttttaaaatttgcatcaaagtccagcttacatgtcataatctaggacaatttgtcacgttagataatctatgtgacattaaaattattaaaaatatatctcattaatggtgttatttttaaatttaacggcaaagactattttgtaaaatttatgcaaaaatagagactattttttacatttaaaaaaagataaagactaatttgcaaaaagaatcaaaagttagaaatcaaaatacctatttatttaataaaaaaaacatcatgcgttagttataaccttaacttctaattttttgctaacgcccaaaaaaactaagaattcgaatcagaagtaggcagaataggcaatttggttcttaaaagtgtatggaaggaaaaattttcctttgactttttaaattggaacacgtcttgatttttttcccttgttgcccaaaagcagtcttattattcatccgttgggaatttttgttttaatttcgctgataaaaaaattgagaattttatgtctgctttgtgaattaccattttatcggaacctgcatactaatcctgattaccagttcagcactaaaaaacatgttatatgcattatataaataatagtaattattttgaagaaaggaatcttataagatatttttctacagaactaggaaacaaaaaatcttttaatgttcctgaaaggttagaaggaataattttgttttggcttgttgaattggaaaatgttacagtcccggtcattctttttatttttatatgtttatttatttttgtccaaatagcagggtcatattcaaaacttgggttttactttcaagctttggaacaatgttagtgtaatttgtgacttttgataaagccaaagaagtaactttcgttcttattttcatgtgacttgtaacaagttacaagtcagtaatataacctataacttactcttcatcatctgcttcttcttttgatcataatatctgttaagtgatctttcatagagagagagagagagagatggagaggtgtgacaaggtgatgaaccaacgcaacatgcatgattgtcctaaaacaggtcctggctatccttcacccctggcagccatgtctggtcccaaagagactctcctttatgtcactgctatctactcaggtaccaaaaacaacttgttgtgtctctatatgtctgaaaaggccaattcagcttcattggaggaatagataggcattaggcagagagatcaagataggtttctcaagttgttgttacaaacattttatatgacatgatactgggaacaagtgacatgtagaaatatctatctctttctagtgctatgcatgaagacttggtgcagcttaaacaatttctgtcaaaacgtgtagtttggtgattttatatatatatattggtgatgaatattcaattcaatgcaggaacaggaagggataagcctgactttctggccacagtggatgtggatccaagctctccaacgtattcaaaagttatccataggttacctgtaccttatttaggtgatgaactgcaccattttgggtggaattcatgcagctcttgctatggagatccatcagcagttcggcgatatctgattctaccttcactggtgtaagatactaaacagccactttggattttacttgcacgcatatgcgcatgcacacacacacataacaaacactgacaaggttcaagaacttcactggtgtaagacatcggttttcttgaaacgaaatccttattaagtcagatttaccatatttcagatcaggccgcatttatgtggttgacacaagatcaaatccaaggtctccatctttgcacaaagttgttgagccagaagacatcataagtaagactggattagcttatgcacacacatctcattgtcttgcttctggtgacgtcatgatctcttttcttggagataaagatggaaatgcagcaggaagtggatttcttctccttgatcatgaatttaatttgaaaggaaggtacccttttatagattagattgagaaatgcaagaatgcatattgggatgtcaaaatgctcttaaattaccaattctattcattttcgcatgcatttagtgagacgtggttttaattgctctttcaacatcaattaacagtctacatggaaaatggtgcaatcatagattgacattttaccactatgcttagaaatgactaaagttttgcaaaatgtttagtgtagaatcattaaataattgttttatagcagcatattcaacaaaagttctacgaaactaatgaagtagttaccatttcagtggattattttctagttactagtttgtatcttggcacacatttgttaggtgggagaaacctgggcacagtccatcatttgggtatgacttctggtaccaaccacagcataagactatgattagctcatcatggggtgctcctgctgctttcaccaaaggttttaacttacagcatgtctctgatggtctttatgggaggcatctacatgtatacagctggcctgggggtgaactgagacaaacattggaccttggtgagtcaggggttctacccttggaggtacattgcttaataaataattctggagttatttccaccaattataagcactttatgttaatgtacttgtgatttaatcataaatatgtttgtcctttgctacattttttctctctagcctgtacttgtgaagtaatatgttaaaggtggcataatttgtaagcaacttgtcctaaatgcaggtaaggtttctgcatgatccttctaaagatacaggtttcgtggggtgtgcattgtcaagtaacatggtacggtttttcaagaccgaggatgaatcatggagtcatgaggtacacaaaaaggatatagtaaaaaatcaatgcctaaattttaggagaatcatgacatctcattaatcagaaggtttacattcagctattctatttttatttcattcctataattttgggattcctggttcttggaatttcctttttaattttcttcaccttttctatatattgtatctgtgctcatatgaaataatagagatgatataattttcatactctactctactcatagatatccatactcattttgtattgtcatctggtatgcgtttgtgcagcttcaaccaaggtataatgatcaataatacttacacactagactgactttgcaggttgcaatatcagtgaaaccattgaaagtgcaaaactggattcttccagaaatgcctgggcttataactgattttctgatatctcttgatgatcggtttctgtactttgtgaattggcttcatggtgatattagacaatataacattgaggaccctaaaaatcctgtactgactggccaagtatgggttgggggactacttcagaaaggaagccctatagtagcaataaccgaagatggtaatacttggcaatctgatgttccagacatccaggtttgtgcagtttaacttttgaaattagtgattctagtgtcatgcttgttgatttctcacatgtttggagttgattggttcttagatgtactagatataatagacttgtgcattacattggtgccttcaaactttttgtcacttttgtattttatcttgtgttatgcttaaacgtggtaaataattgcactttaaattttgaccctttagtggttgaaggtgaagagatcaaaatttttaatttcagggaaataagttgagagctggccctcagatgattcagttgagtctggatggtaagcgggtatatgttacaaactcactcttcagtgcatgggataaacaattttatccagagcttgtagagaaaggatcccacatgttacagattgatgttgatactgaaaatggtggtctgaaaattaaccctaatttctttgttgactttggagctgagcctgggggtccctgccttgcccatgagatgagatatcctggtggtgactgcacttcagatatatggatttaatagctatgctacttgaggccaggctacaagcaatatccatgtgaataaaatccttagtcctagaatgaatcgaggagggctaatgttataaataaataatagttgcatatgtatgatggttgcattgtaataaagttatattgtcatgtagttttcagtactttctcatttacatcatcctaaacagtgttctctatgaaataaatcttgctcacctacaaaatttgggtcttctgattgagtaaatctctattggagtaacattctagattaatggccttacttgggattctatgattttcattcacatcatgaatgtgctgcaccttctacgttgcttgttcccatttgaatgtatttgaaatcacaacccaaccaaatcatttcaatatgatgtacttcttaacaaatcaatgcacaaataattttaatcataaattcagaacttatgcagtgaatattctcgttgttaagttataaggggcggggggaatcttatatatgtgatttttggtatatgaacgtttggtttgtgaattgtgattgtcagatggtaacttgtagggcaccttggtcattcatgtggtgttgaagactaataattcattctaattaggactccaactattttgaaaatgactgtggctcatttggatggacttttgtaaataacctctgtttggtaattagtggaattatctatgagattataacagttatttcaacaataccattacttaaaactaaagaaaaaataaatgagattgaacaacattatgatagaatcaactttctagtttctagagaaaagttgtgtgcaaaattaagtagttggaggtgaacctattccttatgccttattccgtggccacctccaatggttctcatttctcatttttcaagtattagcactataaatggacagacttaaccccaaaaccagtaccagaaaatgcaatgatttgtaaggaatgaagcagtaagcttttgtgaagggtggaaatggagtctcaaaaatctcaaaatcatgctaaaaaggcaaacaagtacattattatggaagttaccaagcgcaacatagcaccatgtagcaaaaactgcctaccgccagcatcaaatccttacaacagaggatgctccaggatatgcaaatgcagaaaatgaagtcttcagttcgttcaatgggaagaataaggaaatcatatacctatttttcatcttttatatttatgcagtcgtctatgatgaattgatgagtgttttcctggccatgtgtgttgttttggcttctgctttgtaaacacaagataataatacaggcacaataataaactgtataatgacatgaagatcaatatctttctttgaagctaagaaaaattgttatagcatgtagctacttttgttgtcccacaaatgtgtggcatggagcaattttttaatatattcaaaatatttattttgtggactcgacagtctacatctattttatgaagtgtagtgaatccaacatcaaacccctttgtcccactttacaaaaaccctctgatcatttgaacctcctaaatgaatacaaactgtgtccataaaaaaaaattattgtgtcctacgtgcaaaaaaaaaaaaaaaacttcactaccctattttgtttttatcatgttaaatatatgaaaataaattattgccaagtccaaattgtttgctactattgaagcctgcatttgtctcgatgtaaaatagtagtacttatccaaacacagtatcaggttgaagcaaactagttcatattattgatgagaaatgcttccaagaatgctatgcaaggtgtgaaaattcaaacctttgcagtgtgtgccactttgtgtaattaaactaaaataatggaggaagaaattaagtaaatgcttggaaccatccttggctttacaatttccatgagtgcaataatttgatattggtgtgaaaggaactcaaagtcatgtcttcgttttattagagtcaaagtaaatcccgaaatccatagggatcccaccacaactgtatgttgaggtccattgtctgatagaagactgagagtttaggtggggcaacttcgaggaatatgtaccaaatattttagatgtatgattatatcaacacacacacctttgcctctgttctctcctttttcttttgccatgataatacccttcctataatcctattcacccaacgccacatttgttttcttgtatacttaaatgtgtgttaagggtaagggcttcaaataagaaacttagctaaaacagttaagtaactatttactcccatcattttgcacaaatttttatgaacttagattttaccaaaggagggacaaaactaagaaccaaaaaattatcatcatattcagaagccacaaccaaccacatgttttctatacatattttttcaatatggggtactaacaaaaaagtcttatttggtatggaatttttaattactctatatttatagtatacaatatacttgggacatattagaattttatcttccaagagcaacctaatctcagttatctcatacatatgcaatcgcttattagcagagtaaatcagtagtcttcacagaaaagagaaaaaaaatcatctgtagcacatggaaaataacataatttccttgttgtccaaaaggtttggtgaagtgcgctctatcagcttatcactaatgcaacttgcaccttttcaaaaaggtggtgtcatatattataatattctctatatagtgcttcttagtggagagtggaaggaagggtacatccaatccaagacacagaacagaagaatggcctcaaaatcatccaccattagacttgtttgtttctgctacttcatgctcttcagctctatgcatttcaccagctgcaccgtgctctcattgaaaagtcatgcaagcacatgcaatggttccatagctgaatgcaatcaagaagatgagctgttgatggagtctgaaataagccgaaggtttctggagcagaagagatcatacatttccaatggagctttacagagagacaaaccagtttgtaatggtggtggctctggtgaagcttatagtaaaactggagggtgtcttcctcccccctcaaatcctcaaagtagaggctgctctaagtattatcgttgtaggtctgactcttgattacatcttcatgcaaacatctttaaggttgttcatgaatcacgccttttcacataatccttatgttgtccattaaacttgatgggaacttttgaatttgaaattatatgaaaatttccaaaaggccctctaataactaatactctgaaggaagatttattatcctgtggcagtgagtaattaacactgaatagtgaatatcacactactgcttgcagattaagtgcactaaaggaaagatctatgattgtattaattatccgtttcttgtcatctccaatctttctttgttccattatgctagatggaatttgattttttcttcttttttttttgggtgaaatgttttggtaatgcacataatgcaaccataaggtataaatcctcttacacattctacctcgatatacatatttaaataataaaatatataaaaatatagaattatataaaatgagattttattttaaacatataagagttcacgtgggtaaagtattcacattcactttactattatcaaataaaatttgtcagaaacattttcggctcaacatcatgcaattaaaccagaaacttatgtctcaatgtcatattctatcagatcattttattccgacatcctccaacataagatttcttaaagcaatccatctagtcatttgcttccacaaacacaaggttcgagatcatcacaagatccaaacacaaacagcatacaaggaatgagttatcacattcccaactaatagagagaaacgagacaatatgtagatatacatattatataaatgaaatataactcacttaaacatagctcacatcattccatcacttatcgtgtaacatcacatctcaacactacacatctcacacattttcacattatttacgtgctcaaggatcgaaacacaatatcactcaaccaatcaatatcgaccaatacacaagcgttatgcaacaaatatactaagacttaatcctatatgtaatgtggtatcatgtcagtgaaaaatctcatcaggcgcctagaagtatatgacaagataaaccacacactggtaagtcaggtcactctcattagataaaatcataaggagattagttagggtcactctattttgcgagaacacttcaatcatacgaaatcaacataggtttcaaggaacattcaaaccgagtatatttacccctaaggcctacactctaaagagtccgttaggacctctccctcttgattcaggttcaacctagaaaatattttagcacccagactctatttatgaactgtacaaaacactcgactcctcaattgttctcaaaataattttatctcatcgcgcctcaaagtgattaaactcgtcgagtttccacaatggttctcatcacaatactcgtcgcacattaactcatcgttctgaaagggtcttatagtcgtgtggtggtacggtacataactcaaaactccatgcacacaatatttcaatacacatgtattttataattcaacacgcactcaatttatcacatacgctcaatctcgttataatctcaatataacaatttatcacactaatataataaattttgtccaaaacacaaacgaattatacaaaaatgtttctcacatggggagtaaaacccttcaaacaatttcacataatcataacaaaatcaaaggcaaaaaacacaaaaacaaatagcactcaattttatcaatcaattcacttcaggacatcaattggcccgtcaaacacaacaatatcataattataatcataaaggatgaattgtaattcaataaacatccaaaaataaactcaaatttaatcttctaaagatccctacacatgtttattctaacctcaattgcgataaactcatctcttacctctaagtaggctcacatgtgtagtctgacaacgatagtgacgtttctagcgatttcctaagattcttcaaaattttcctaagattttctaacattagagaaaaagagaaaggattataacctatatttcactgtctccgtctccgtgcgagggacatttcactaactgaagacattgtttcacaaatcctaatagtgggattgtgagaaaatgagtttcaaacctgatttttaaatttcacaatgattcaatggttaatgagtccgagatcatagttttaatggaacaagtttggatgtatgcaggaagagcatcttgtgagggacattgttctcaccacagacattatttaaaaattccaacgatgggaatgtgagaaaatgagtttggaacttggtgttcaaatttcatgataattcaatgattaacgagtataggatcgtagttttacctgataggtttgagtatatgtggaaaaaaagaaaagattttggaagagaaaaaagaacgaatttgaaaggaagagacagtagaaatatattatgtgtaaaatctgatctaatatgtctatttatagatatggtactcttaatttattatttactctagcttttctttattttattattttattaaaaaaattctatttttactccctatcaaatgaataaataaaatattcttttttattttccttcaaactattattttaattaataaaattattttttctaatttatttaattataaaaatcttattatttttcaaaaactctatttatttttaaataaaatgcttttaaatttatttaaaaaaagacgagatgttacaaatgtttgaagcacactttgcaatgttataaatgttgacctcagacatcaattgcaatatacacaccataaaacaacatatgaagtacacgtatgagataagtgaatatagaatgaagctattgaatggttcggtaattgtcaagaatctaacaacgaacatagaacattaaggcatgttacagcagccatatgcaatattaattatcagacgaaatgcaaatatgctatatgtgtaagaaaggcaattatgaaatacgtatattacaagtggtgctcgaatataatgaatctaaacatatatgaaaaatcagtaactgaccttttcgacacagtcacatgaacaaactcgcagcaacaacgcatacactagtaacagcagtcagcgcactctcttgagaaaatttgatgtaaatgtatttataactttgtgacaaatattttttttccctcattccacacaggaataaaaagtgtccaagtgagtgaaagagatgaggaatagatagacttctttctccttattttaaaatcccaagaaactaattacctagaacatttgtaacaaaaactagtgttaatttatttccatttatcccttttctctctgctttatttgtgggaagctataaagaacgctcttctctcctgaaaattgctcatttaagaaattattttcgaaggaccacattttaatctgttagaaatagcccaaaaaaaatagacagaaaaattactctaatttttttttttttttgaatgattgactagtcaaattaactccagtaaacaaacaagcagcggcgggttgaacatgaataactttcaatatgcccctttgttaagctaaaagattaccctaacatggaagtttatgctacatatactagtacaccgtcaccaattgaagtgtcactcttgggagttccagtcagtatcgaagttgcacgtataaatgatcttaaattgtaaaacagtggctcctgaagcatcaatgggcagcaaactcaataaaatcctaatagccagctagtaataaagtcaaaatggtgacaaaatacaaagaaagtcagtcataagcgcttgaagacattaggctaggctggcaggacttcaaatcagctaggattcattaactggggaagaatatccgaataaactagtgatgaactcctatcacaatctgcacgaactgccttccaagatccataacatgcttgagccgtgatgaactactttacattctgtattaagacagaacacaagcatacataggataaggtgatatctaatctggtattaatccgtgagctataactgaaaggactatatcttcatgcatagttttgtaacttcaagttcatccagattccctagattcccaatctttcaacttcttgcttcctttaggttttactataggtgcattcattgctgccattttgtcattatactttgcacgaagtgggtcattgtaagtccacctgtattacaattcaacaataacaagaatgtcgaataattttagtattttacagcagttaatatgtaagtataaaatgctacttgcagtagaagaaacccttttttcaggggaaggggaggtctggactctggaggttagttgcacgttaagcaaaatgaatccctatcatcaatgtgttaacaaatccaaaattcttggtaagggagaaatatcggacagaaaaaaaattaagatgtcagaaagccaatgcagaattttctcagcaaatacattgaatgctgccttaacatactaaaaccccattattcgaaagatgattatcaatatttaataacatgactgcaagcctatcaaccaacaatacatgaaaaaattctggtgtgataaaaaaaattgtgtagactccttttaatgtcataaaatcagaagtgtggcagaatcagtctaacatgttacatcaacattgaaaacataaacagattcaggactctgtagataataaatgtagcatttcagatattctcagaacagagaataaaccttaatctagaaattagtatagaatcataatttttaaatgttatgtaatactctcttttaatgtcataaaaaagagtagactccttaatctagaaattagtatagaattctggtgtgataaaaaaaattgtgtagactccttttaatgtcataaaatcagaagtgtggcagaatcagtctaacatgttacatcaacattgaaaacataaacagattcaggactctgtagataataaatgtagcatttcagatattctcagaacagagaataaaccttaatctagaaattagtatagaatcataatttttaaatgttatgtaatactctcttttaatgtcataaaaaagagtagactccttaatctagaaattagtatagaattctggtgtgataaaaaaaattgtgtagactccttttaatgtcataaaatcagaagtgtggcagaatcagtctaacatgttacatcaacattgaaaacataaacagattcaggactctgtagataataaatgtagcatttcagatattctcagaacagagaataaaccttaatctagaaattagtatagaatcataatttttaaatgttatgtaatactctcttttaacttcacaaaattacaagcaagcaaatgataaaacgtgaaacccaaaagtactatgaaaacagatgagcataactcatgagcatgcacttttgtcaagatctcaaaccatatcaagggctgctaataaacaactcatttaaattgtgagttgtgacatgcaatatgatcccttcttactgtccagctaaattcacatagaagtcaagggagtcagggtaaagttgacaaactaagaacgctgtaaacaataaacttcaagccaagtacatatttctacaaaatgaatgccaaaaaaataaaataagatttgtgagatggcataattatgcttactctaaatgaaatatgtcttttaactatattccttccaatcaactctccctcttgaacctcaatctcacccacaatcaaattcctaaataagcaaaatgataggtaccagcaagctagaaagactaaaatgaagaaattaagcatagaaatatttgtattccagtaacaggtcttcatcaagggagttcagatcctggtatcttctgtgtataatggtacaaaatgaaaaagattcctagacagttatgagagtgtctggtttctcccagcccaagcctaattccaccctaccttgtacacacccttctcgggctaatgttctctgtcttcttacaacaagcccacatgcactcctcccatgctctgctacagggttgacagttggttatatctctctcctaaaattgatcaagtgaaccttttgcctatccttacatacaccttattttgtgatcttgggccttggggcctccatcagaaaaccattcttcataaaaactctcatttcactcttctgatgactaatagcagaaaattttttagataacaagagaaaaagaaatcttaaatgaacatttcactattggcatgagcatctcaatatcatcacatgaatccgagatcattttggaccagtgccatagcagatgaacttcataagtaaatgtgaacagatatgccatatttttttctcaggataaaacaacaaaaaactaataccaaagaatagaataaacaatctaccactattcttgaaaccgaaagatatagaacataggagaaattgaacttacgggttattccaatcagtagtatcctcattgacaagatgggtccacttggttcttccactacgaccaaagtgcttaacttgcataacctttggcaatattgtcttgtccattttatcctccccagttggggcagagaaatcacgagcgaaaataccatcagatccaacggtggcagctcggtcatcagattcattctggaagaaagcacctttgtgatagtatttctgcataaatctccatttctgctttggtggtggagcaggtttgggattcctcctttcccactccctcctctcttcctctgtcatgtttctcaccttctcaatctcttccttttccttcaacattgcctcccgatcctccctatccctcttgatcctaccaatctctctcactttccaagcttcatattcatctgcctcattaacttcatcatctgtatcgacatcagcaatgttggcctccatttccaagtttttctggatttcttcatccttccggatctcctcaacaacaatctgcttcgtctcaatcctcctttcctccaatctccttttccttttctcctcaaaagccagctcctcagcctcaagacgctcacgctccgcaatggtatctctctcagacttgggaacaaacacaggcttcaccatagccactcccgtatattcctcatcagagtcagtctcatactcagattcctcctcctcctcctcttcttcttcctcctcttcctcttcctgaggaagtgcctcttcctgctctctctgaagcaacttctctttaatcagcctccttctttctgccaaagcattctcatcttcttcttcgaactccaaccattcctgcctcctggcctcctcttcaatggtggaaacaatctcagcctggcgaatgcggcgatgatcagcccggacctcctcacggttatctatccggctctcggccaaacggcggagcctacgatcgtcttttctgacaatagcagcgtcttcttcgtgacgaggaaaggctttctccaaggcagcttccctggagggtctaatatcggcaggggcagcatcttcttcgttctcatcatcagcccattcaggaactttaccgggccaataacgcttaactttagtttggccaattttacctctgagcttatccctaatggctattacagtatcactaacacccgctgtcaccgacattgttcttcctcaattgaacgccaaaccctatattgcacagatgcatagtaaatcggtaaaatgtttgtttacacagcacagaaacagaagattccagattaaatagcaagaaaataaataaatgaatcaagaaacacagaaagatcaatagtgaatgataaattttgatatgcgaaacattggaagggtttgtgttccaaacactaacacttgaattgttagagagaatagaagaaaagtttgaaggacttacaattacagcgaccggaaggaaccctctctgtctctgtcccgttccaggcagcgcgtcgccccaccccagcttgttctgtgaacttttatttgatttactttctatagtatttatttttgtttttatgagtatgtaaatgacatctttatacgaatattatgttttcattaaataataataataataaatttcttaaaattaaatatatatacactaatgctcataaaaaaattgaacgaatatcatatttattaaaactaatttttttatactaaactaaaaataatttaaaatttattattattattattataaagatatttaaattttatattttggaattgtatatataagataaaatacatttaagtttcctaagttacaactttcgcatcggttacattttaaaggttatatatatatatatatatatatatatatatatatatatatataataataataatttatgaataaaaaaattatacagcaactagttgtcattattaataaatatagatgataataataatattgtagcttgttcctaaaccctctcctgacaaaaaaaatcctgaaccctcgccagattctgcaaccataagcagtttccgacactgatgttgttcggaagcaaaagatttagtttttaatgcttcgaagaataccctctttctctcgttttcgtcgtcttcatcacatgatgggtactttctctcgttccctttccatccgctctccttcgttttctctgtttttttcaaagcactgtcattgctccacaaacacttatgacaccgatagccatagcaacggaacccagttcttgatttccatgagaaacctatgcaagtcaggtaaagtgaagaacattgatgaagctttggacttgttccaaggcatggctagcatgaagcctttgccttctgtgaaggactttactttgttgttgggtgttattgtgaggttgaagcactacaccactgccatatctttagttaagcacatcttttcttctctaggcatagaagctgataccattactcttaatattgtgatcaattgtctctgccgtttgaagttggttgcttttgggttctctgtgttggggactatgttcaaacttggtttggagcccactgtgatgactctcaccgctctcattaacgggctttgcgtgcagggcaatgtggctcaggcagtcgggctggttgatcatatggagaaaatgaggtatccattggatgtttacacgtacggggtgttgattaatgggttgtgtaagacgggagacactttggcggcggttgagtggctaagaaagatggaggaaaggaattggaaacctaatgtggtagtttacagcacaattatggatggtttgtgcaaggatggattggtatctgaagcgttgaatttgtgctcggaaatgagtggcaaaggtgttcgacctaatcttgtcacttacgcttgcttgattcaaggtctttgcaattttggaaggtggaaagagactggttctctgctggatgagatgataaaaatgggaatgaggctggatttgcagactctcaatattttagtggatgctttctgcaaagaaggaaaagtgatgcaggctaaaagtgtgattgggtttatgattctgacgggggaagggccggatgtcttcacctataattcgttgattcatatatattgtttgcaaaataaaatgaatgaggccatgagagtgtttcatttaatggttagcaggggctgtttaccggacattgtggtttttacttcacttatccacggatggtgtaaggacaaaaacattaataaggttatgcatctgttggaggaaatggctaagatgggatttgttcctgatgttgtcacttggaccactcttataggtgggttttgtcaagcaggtagaccattagctgcaaaagaactgtttctcaatatgcacaaatatggtcaagttcccaatctccagacttgtgctgttatattggatggcctatgtaaaggaaatcttctttctgaggcagtgtcgttggctgaggcaatggagaagagtaatttggatcttaatattgtaatttatagtattttgcttgacggaatgtgcagtgctggaaaactgaatgctgcatgggaactcttttctagtttgcctggtaaaggtttgcaaattaacgtttatacttataccattatgattaagggtctctgtaaacaaggctcattggataaagctgaagacttactgataaatatggaagagaatggctgcctgccagataactgcacttacaatgtctttgtccaaggcttgctaacaaaaaaggagattgcaagatcaataaaataccttacaataatgagagacaaagggttttcagtagatgctgctaccacagaaattactatcaactacttatctactaatgaaggagacaccagaattcgagaatttttttttccaaaaagatagcaaatgccaagagtttcacttggacatttattcaaatcctgactctcaattcatccatgttccacaatcctataggaccccatagagagaactggcataggcttcagaacttacaatttgttaaatatataaaatcattaccattcaagtgcatccacctgacaatttatgtgattaggagagttggtccttaacaggtatcacaacctttaagaaattatgagattgatccttgttgcttctcttcttcataattaacttatatttgagcccaaggtaaagtgggtttgtgcattgtccgcacttcaagctcaaaaagctctgttttaagggggtcttagatataaatctttcttagctccaccaatcagcttaagctgtgaatagaattgttccttgacatttttagtggtaagtattttcacctctgcttgcacatttattttgatataacctcaagttattaaaatagcttaaaaaaatagacctatatacaatttagaaattgtgctgtatccttgcatttttatggaactgagtaattttttacttatgtatatttgccttcaagtaagtttaataatgaagcaagttgcattagggataagccaatcaatattgctagtaaatgataattgacagcttaaattctgccagggtaaattcaatatacacaagaaatcatgtaattgcttattgcttagttttatacatttgtcaaatggattccatttatgtaaaagcatttaataagaccataagctgcttttagaacttaatcctttttccagctacaggtattaaaattaataaatttcaactatgaacgtgtacctcattaggttaaatggaaaagatctcatcttctggtctatgatataccgtgtagaaggggaacttttgtggaacacccaagaattttgtttcatggaaactcctcactcaaaaatactgtagcatgagctagcgttcagtagcttccttttatcatggatagctctttggagctaatgttattttatattttgtttcctttcttgtgtattttacttttctgttttaggaggattcctgatccttctgcactgtactccttttctctcctagttcattgtttgtgatgggaaatttttttccatatttattacctgttaggagacgaaaatctaagatctaatttatggatgcttgctgtcctttctgcaaacgtttttttttttttttacttttgacagttttccccccatttaaaataacagtttgacttcatggttcttggtttgcagattgaaatcactttatgcactcattttgttataacttatgtgcgaggaagaccgcaaatagttcagcgatggatcatagaaggttagtcaaacattttttctttgcaatatctgctcagcttgttttttgtaattcaaattttttagcatcataagttgttcgtttgaaattttgaatgaatatttatctgttaagttatatttcacttttcttttcttgtcatttctttctatgtttcagactaggttatcattaaacgggtaagacacagactctcagctgaatgttttatgggagcgactagatggcttccacatcaagcaatgatgttcattagatcggttactgggttttgagatgtaaatgctgattctgtcgaatggtatggtttagtgatagagtgaagttgtgattttgtcttcttgaaagttctgtcatctagttcttttgtccataatttaaaatattcaatatgttgggcacttgtcatattaagtgagggtaatttgtaaattttattgggttgcagccttatgcttaatgcttcatattcttgctttaatgtaaagctaaaaatggtttgcatgtgccaaggagcagtatccttgaccatgacactggtttagcatttgaatggactgccttatatattgattcttagtgaacagtacaagatgtgagaggtaatgatttttgtaaaacaatcaagtcttactctactaggtgggatgattgtctatatggatcaatcacactatagggcactagcaatatcctgattttcagtaaaacaatctagagcgtagcttctcttaattggttcccctaatattttcttttgtccccctactcttataaatttaaattgaacaatcctctatttgatggcttcggctcttttctagcacttgagagcaaattttcccccatttgatccacatttagtttactcggtaatcacatttttcatcagaatgttttcaagaatattcttcaaaatataattaattactatatgaaacagatatctccttctaatcacattttgaaagattatattttaaaaaattgttttcaagaactgctctaaataaattgactccaaaacaagcaaattcttaatcttaagttgaaacaacactccaaacttgtttaacaaaacaaaggttcaacaattatcccactattaaaattattcaaggaaacacttcaccgtctatatcatcagttattttcatttgttgtatttaaagaattactcctcaaatgatttgactgggagaatgacataaaaatatatttatctcagaataatgctttgacttttacaatgttcccctcacaaaattgatctctttaaaaaataaaaaataaaaactttggagtttgtccagcttggctccaatcttaaccaaagcagcattaaagctttgaagtatagagcaaaagtacaccatattaggctaatcaatgaaaaggtacaaagctcccgtcagattttgaactaggcagataactaagggagtgtttagtttggttgttttttgattttattttcactgaaaataaaaaacggtgatgaaaatgtgtttggtttgatttctgaaaacattttcggtaaaaatgaaaacagtaaacaactagaaaatgaaaacaaaaaattttcgttttcagtattttcagttgagaacagaaacctcattttggttaaaatgaaattgcggtgacaataaatgtagttttaagcaaatctaaaaatacaaaaagacaataagtcaatatatcataaattttcagtatttttatttcataaaaacagaaaacaagaaatcaaaccaaacatattttcagaatttaaatcttttgaaaataaaaacaattttcaaaaaataaaaacaggaaatgaaaacagaaaatgaaaatgcaaaccaaacacaccctaatatgtaaccaatgttcccaatatatagcactcatttagtagacagtaatacaacctggagaagtggtgtcccatggtgagggtttcagacaacattaagctaaaagcacaaagaaagtaattctaagaaaccttccattggcaactaaaactagaatcgatattcaattagtccccgcttgcacaacccttgcatccacagtgaacacactctatgaccttctcctccctaagttgcttgggtactctgcaaacacaagtggtggcaaaattgtgatcacgtggctgcatgcacctcaggcagcaaagacgttcataaccaggctgcaattcagaccaaaaacataatgatttaagtactcaaaatccaagaaaactacacatagaatgcacaaatgaaataaaatcttggtgaaagtaaaacgacactatttttttaacattttttgctaccaagtaacaataaccttacaacaattaacatctcggagaaggcacaaatatgagtatagaaataacatacttcctaatttcaacagtactgaatatcacacaatgtgagttcagagtgacccaatgatacaaacatggatcggctgtgggaaaacagagaagagaacattttattagttgggacttgagaggttcttcataggcctaaaatgaagggggattaggggttggtaatttggcatcttaacacacaaacattcctttcagaggttaaatgactttggcactttcctttggagactaatgccaagaggcaccaactcaccaagtatataagactaagagcaagtacaacccatcagaacaggtggcatgctaaccaagtgagcaacactgctcatattagattttgggattggaaggtttttttgcaggaatacatgtctattgtttgggtgatggaatccttgtcaactttggagaggaagcttagatagggagtgctcctttttcagagacttttcctgcatgtttcaactatctactttgtgaagtttgctcattagccatttctaatctaaggctaagaatctaagatcattatttacaaagggactgtaatttacttggatattttaatatgggtaatatagtgaactacaatcccttttgcttttacacttttacttgagtctctttctcccccaactaagttagttagaagagtttggatcatggactcttccagtattttctcctgtaaagctttctatcaatttcatacacacgcctaacctaggtttctacttgattaatccattttaaaattcaaacatctcttcaaaagccaagtccttggttaggacagtggtacttaacatggttaatgcaaatggtttgttgcaaattcataatagacctttcaaccagcttttggctcattttattgcattagtcttatttgttttggagaatttcttttatttttttggtaactagcagatttcttatcctcctcctagttgtgcttctcttttctctttaatgaatttcctcctatgtaaaaagcaatagaaaaagaaaaccagttttaaaaaaataaaataaaagaactaatttcaggtaccttcttccattttgcaattagattgcggtcagcatatccttgatctaaacagaattcatacagttctttagaaatttccttcctccgatggtatagatcaaatatgtagcggctcttctggtgtgcaatcttaaatataggccataaggtctcacattttcttttgccatcatgcggatcattctcagctgccacataaaggatataaaactattcatttcattgatttcagaaagaacataataaaacctactaagaacatgatgtaaatttccaaccttccctcatctttgcttgaagttcacggagtgtaggctcaattaattcccagccctctgggtatttaacacgatttgtctttacttttggcatttttgtatctgttcaaggaaaacatggcatcaaagagtcaatttccatacattctcccaagcaatataaatggtacatattatttggtacaagttatgaagtaagcatagttatcaatctcaggcagcaatccatagtggcctaccccaaaaatgctatggcagtatagttcatagcgagattggcactatgataaatactcaacattcatgacatgttcatcaataataaaaggtcatagattttaagcaaaacataaaatacaagtaaataacaatacaagtcaagaaaacaaacaaaattcaaaggcacgttcatatttcaaatttcagatacaaagcatcttaaacattcaataaacagtgagggtgggtgttgcacagagaaaagaacagaggttcagagttcaaaggagaaaaatatggaaggtgagtgttgccagaaatactgccggatatgcacggaagttagtcaaatagtgagtgtcacacagtagacaaaagcgagagaaactagatccaattagggattttcaaattcttaaaaaggggaggaatatctcaactgtgcactaagaccacacacccaacccaaaaaccatgctgttttgagggggaaaatgggttttcaaagaagcctcaatctagcgccacttatcaccgatagagccactattatggccgtgattgcagccactacaccgttattcaaaactttacagtggccgctttgcgctgctaaagtgcgctattgatgcagatctttgatcactgagcagaacagaacacactacggcttgacttggttgaaatttcacataaaaaaatgttaaactaattttgaagaaaaccctaagccacagcattcagccatataaataacattacgaggctagggcacgaagccatgaatgaggggaagagaaagtcttagtcacaaactatgaaaaacaaaacgaatggcttaattcactggtcagcatatagttgttcatgaaaaagtagataggaacactcctaaaccagacttgattgaattttacatgaaatatgtgacactaattttgaataaaaccctaagataaagcattcaaccatataaataaaattagggcaaaaaaccaatgacgcgtacctctatgctgatttagctctagtctgtgactcgattctgaagataggtagagagaaaacaaatactaagataaaacgaaaatcaaagtagtaaacttgaaatatttaatccccacgtgaaagaacgtacctcagaaagatttgcaggaagcgaaagagggcaagcagaagaggagtgactttgagttcttctggaagtttcacgccactgaaataatccccacgtgtgtaagacgatcaatgaaatgtgaattaaatttaagagtacgtggcagagagagtgtcctcagttacaataacatgaaggagtttacttcatttttcgtttcagttgtataaacatatgaattttcttttttttctttctaaaatattgttattgatttcttttaacttgttattattctccattcttcattcaaatgactgttttagagtatatgtatgtaaaattgtttatattaaatttcaataaactaaattaaaatttaaagttttattaagtaaatctagaaaatatataacttttgacaaaaaaattatatcactatttaaatatatcttttttcctttgtttcttatttcctaaataaatttttttattaaatttattaacaaaaatttctcataattaacgaatgaggttaaaaataataaaaaaatgacaaatataataaaaacaaattaaatttaaagacttgaaacataatttttgtgtctcatgaaaatattttttttattctaaacaaattgtttaaagataatgaaaatatcatttttttaaatcctataaatataccagataactataattatttaaattaaatcactctagcatatatttttaataaatcaaattaatatatacaaatattttaatttactttaaatttaaagataatacgataatataaatatagtaaaattttatagaatttttaaacaatattttccatttatcttttttttttcttttatctctctagttgcatggagcatgagccaacttcctagtttattgtatattttcgtgataatgttgtggcatttgttagacattttaaaatattaaatcttattaattatttttaaatcatatttatatgaaaaatatgattttttatttaatctttctagaaaaatcttaatgtatccacttccaacttttacatttaaaatcccattatatattttttttctaattaaccttctctaacaattgttcaacactttcttcctaaacctctatttcagtttctctccctcttcggtcttcccattgaattccaggattttacatacaaaaaatttgatagttttgttgtcttgacaagttttcggaggatttgttaaattctaaaggacttatgcactacgttgataagtctttgaagaccacgtgatgtcactcatctcatattatctattttgtgactaactcatgaatttatgatagattgatgatcggtgattttggcctactacaataacaattttaacttttaaggaataatcccgaccactttaaggtatattaatatattaattatttttttctccaatcttaatttaatttgtttgatggtaatgaatcagatcaacgattttgggactgttgttgttgttccattttcagttttttattttgtttatgactagttgagtttgcaatcggttcttgctcggtgattttagaggttttggacatgattttagagtatgttgtattgtgtaaaactttgttgcaatctcgtgtggttaaatgggtgttaggatgtgaaaattttatgtctaaaatttgggtgtttataggattttataaaaaaaggattcgcaaaatatccatcagaatgagactttattaagtcatctgaaattgacaaataacaataacataatctttatgattggaagtctcgtataaaaagtttatgtgaataaaatatgttatttattaattaaactaacactaaaatgtgtgagaaagtattaaatactacattaacaataacttttaagacttgtaattttttaataattattatctcttttttgagagtgtgtgatttgcaaatcatgcatcctaagttttttaagtaaaataataattaaataataattttttcagtatcttaaaacatgaatcattaactttatatatatatatatatagattatacaaataagacttttacaaatgatgtaaaagattttactctgcaaatacacttgtgcattcaaatatccataatagttaataacaacaacttattcaatatactatattatctagggtcactagattaaacccacttctaaaaaaatcttaaaacatccaaattttattaatacgttatcttgaacatactttcttctataaatgttaaaatttatttgaaaatttgaaatcttagaaggtctcatactttaattaataaatatcttttataatttttcatgaatagtacaatcaagtgtgttaaaaaatattttcttgaaactcctctaaatttaatgctacaaaaattactttttcttgctttctcttcaaacttagtgagcatttttgcactcttaaattatgtttgtcaaaatatttgaattgatttttagtttttttattaacagaaaagtttatttagttgtttgataaagaagttttttaaataatttttaacatttttttaaacactacttcaagtaatattttttaaaatattatttattttttcatatattctttttttatttatttttaatatatttatcaaatttattatttatcctttttaagcaaatcattattttattattttaaagttattttatattttttaactatttcaaaaactaattttatcacacacttaattttaataaattaattttttaacttccaactaatttattagttttcagctaattttatacaacataatcctaatctcccatgcttaaatttacccctatattcttataagaaaaaaatcacccgcatatttttttcccaggtcatagatcaatgtataactatggttggtgtaaaaaagttttataactgatgaaaatatcaaatatttctcccgctacatatttttatttacctgaactcaacaaaacaaaaccttacgtatgagtttaaatgtactaatcgactagagagagagaggaaaaaaaaagataaaaatagaaataaatagacatttttattcccggaggaccatatgtcatgtaggttatttcgtgaatggtgataattttgttgtattttttcctgtgagaaataaagtttaaatttttatttttaggaataaattttttaaacgttcatatatttaaaaatgaaaataattatttattttaaaatatatattccatttttcaaggtgggtaggaatccccaacaacctgcagcaggctacggtatagaccacgttgaagtcaaacaaaaccgctttttctctctctaaagtgcatagcgtcagcgtagttgcaaattccaggttttcttcttttactcaattctctctctctctctgaggttctggaaagatcaattccattccgaaatggacggtgcgccacaatccgccggtggtccggcgccgttccttctcaagacctacgagatggtggacgatgcctccaccaacgacatcgtttcttggagctccaccaacaacagcttcgtcgtgtggaaccctcccgagttcgctcgcctccttctcccgacctatttcaagcacaacaacttttccagcttcatccgccagctcaatacctacgtaagtttttcgattcctttgtttcgccttcggattcatggcgcgcttccttcgttttaattggattctaattcgttcttctgatttatgtcttccgtttaattgtttgcatgtattgattgtgcctttgcaataaaatgttgatcgccggatttgactaattttttgtaatcgttgttgttggatattggcactgagctgaattgtaatgttgcatgtgtatgatgaatgatgatgatgtgagatggagaaaaatgtatagggagatagagagagcttcaatttgaatctcatagagtctatttgaagatatatgttacttagggttaaagagatcgacaaggtttaaagataggtttctttttggattgtgaattggggtaattggactcggacgtcatcgaggaaggtgatcagaaaaatcgaatgctgtgccttggggtattccttgctcaagcgccagaaaattatgacactcagccgaaggtaataagaatctggtagtataggacttgacctgcatcagagaaggtttcttagtcttctgcaactccctgatatatagcacatacttatgaatttccaaatcaccaaatgtgttcaaaggttcttaatcctggattctgctattctattattgacaaggtatgcatgatgaataattattagaattagaatattaagatacgattcttaagtgttttatgagtcttacaatgttagcaatcatagtaggctgcaagcgatggttgttgtacactaatacttgacctatcttaaaatagtggttggtatctataacaaacgtcaatatagatcattagatctcataataatttttctttctctattttttggattcttcttataagtttaataccagtcaacggctaatagtaaaaagtataaagcggtttctaaaaacatatatatgcttttcccttggttctccaaaagtgaatttaataccgcttatgtttcaggtgtcactagcatgacaatttggcggttttcttatattgtcgtttcacagagtggcactttttaatgttgtgtttttgaaaccgttgggaattccaggagcactagagaatattgtatgataaattaccaaacatgatgaaaaattcatgctagagcattttcggttgttttcatgaataggatttgttactttacctttaaactttcttcctccaccataattgtttttctttatccagaaaaagatggctgacagaggtgcatatcagttcatgtatgtctattagtaggtcttaacaaaaaatagatgcctaataatacttaaatactcttcttgggctgtgctattgaactgttgagtgtttatgcacttgatgttttgcactcagttctttattttcagtcctaagcacatattccctggcactttatttgatcaattggtgaaaatgctcaattttataatagcattttccttaagttcttggttgcaataagggctataatgttctttttgtgttaatctgatattaaaaatgaactgaatttggaagtaaagacataattactagcaaagggaaggaaaagagctccagtagacactttgtattctcataaccagtttgtatctcatctcaaactggtaccttaacattttgaccgaccaacaacactactgatctggggttgttactcactactgcaacaattctttcttctttggttataattacaatagaccaaaaaatgactccccaaaaggtaaggctgccaatgttagataactaaagccaaacctattagttccttcgtgtaagcaggtttggatgggtttttgtcactattcactaaccctaggcccctccaaaaggcatattcaatcacaaattcctttgaaaaatcctgtctccttaatactggagttgttattatcacatctttcaacttcatgaaagccatgtttcttggtcaaatcagttaaaggtttggccatcttgccattatcctattacaaattttggtaatttcttgttaaacccaagaacccttgaatcccctttagaattcttgaaataggccattctaacactcttgatcatttttgtgtctgtagccaactaggaacccttttccttaagataatatgcccaagatactcaacaaattttctcataaattgacatttatttttatttgcaactaaattattttcttttaaatcacccaatacttccctcatgtaccttatttgagctccccaacccttgctataaaccaatattgtcaccaaagctcatgctaccacagaggtactgattgcttgttcttgaaagctgctatttttgtgcttgtagttgaatgccttagtttcttttatggatatttagtcataaaaggatatttgggctttaattttctgtctttggaaatgttgttggctatgattactgtgtaagcccattcaggttgcattttaactttaagagacccatgcatattctatagctctgtactatttatggacagaattgaatttcgactttgagtgcaatcaaactctagaaagtgtgatgctcttgctagagttacttcctatttcctagatccctatttgtgtgaggctaatattacttttgtgttactggtttatttttttatccatgggttgccttggaactttagtcctcaaaatttctccatttactataaactctgaccataatttcagttctttaatattactttcccacaactcaaacactgcctacttttgctttccagagggtttctttcttgtaaagagtatatacttgtaaggatttaatggtaaattttagaaaattatagatcttattgcttgaaagataaattattctttgtgggcgtttattttttttctttaatacatattttcaagcatttaataaaaccattatttggttttatttgtttttgtctattgatattgctctgttatcagggatttagaaaaatacatccagagcgatgggaatttgctaatgatgagtttctgaaagatcagaagcatcttctcaagaatatacatcgcaggaaacctatccacagtcatagtcatcctccaggttctcttgtagatccagaaagggcagcatttgaggaagaaatagacaaactttcccgtgagaaaaattctcttgaatccaatattcgtaacttcaaacaacatcagtcaacagcaaagcctaagctagaagattttctgcagcgattagatggtgttgacaagaggcagaaacaattgctgaacttctttgagaaggctcttcagaatcctactttcgttgaacatctttcacgcaaaattgagtccatggatttatctgcatataagaaaaggagattgcctcaggttgatcacgtgcaaccagttgccgaaagtagcttggtggacaatcatagcaattttagaatggaatttggaaatgttttccggcaagatttttcgaataaactcagactggagttgtcacctgctgtttcagatatgaacttggtatcacgtagcacacagagttcaaatgaagatggggaaagctcacagaaaaagctgtctgaagtagaaccaagaggagtgcagacaagaacagctcttacatttgcacctgaaacattagagcttgcagatactggggcttcttttacttttaagatggattcatgtttatcacgaagagcaacaactgctgagagctcaaaactgatctctttggagccaagtagtgaagaaggcgatagtttatcctgccaactaaacttaactctggcatcttgtccattgcaagtgaacagaaattcatactcagccagatcaccccaaattgactgtcaagaaattggaaaattggcagaatcaagattttttgccaatggtaaagaatctgatagtggtgtttcctcaaacctaaatgtagctgctgaggctaccaatttagcttcatcacaggaggctccaagtaacaaccaagttaacccagctcctccagacagggtgaatgatgttttctgggaacagtttcttactgaaaggccaggctgttctgacaatgaagaggcaatatccaactaccgagcaaacccatatgatgaacaagacgaaggacggtcaactcatggaatctctagaaacattaagaacatggatcaactcacactttgagttgggcatgctgtcttggagaacagttaaactatttttatatgaatttttcatgactaatacacaatatgatctgaaacttcacagttgacagttgactacctgatttatcttgtgaaaaatccgaaatgtttaccagctttggggactgatggatacaatgttaattaactgttgtaaatattcaatttctgattgtctttcaaacgtattcctgtaaacataaaagtcttgattatggatttttttttcttcatgtttgcgtagagagatgtgcagtaagtatttgctgaatagaccagctttactttccattacacaatggaattccaattaacacagcatggaaacttttgttcagaacgcacattgacgtctatattttctcttgctacatactgtatacaacgcacgaactacaacggtttattttcgcttgcaggaattgtatgttgtcttcaaatcatgttagtttcataacttttgcgggttgaatattttaagaagccaagtctcccctggctaaaatttcaccgatagtcagtgattcactcgtgattttaaaactaattccattttacctacttatttgaattttagaaattaccaaatacactctaaactagaaatgcgtctattttatgagtaacccaacttttagtttttgaaactgtatttgttagtcagtttagtctctaatgttacaatttttttcattttagttatagattttataaaatgataatgaaaaatgaaacgaaaaagatctgaaatgaatgatattacaagtttggaaactaaagtaaagaatttgtaaaatcaaagactaacgtgattgatacatataagagggcatacttatttcttgtttgtcaaaataatttgtatgacgagattagcagaaaaaaataattgcaaaattagcagtagcaacttcacaagaagagtttgaagcaagattaaaactagttatggaaagcaacatgtagaccaagaagaaaatacgtctagtaatggaaaaagtacctacaagacaacaaatatgactactacaaaatagaattcgaataataacagataagaatctcgacaaaataaataaagtaaaatatgatagcacagatgtgttaaataggtgtatacagtattttctctctcttctctttctttatctttctaggtgttaaatagtacatatgtgttcattgatcatttttcatattaagttcactgcatgatacctttaatattattaactagttgtctagttgtaactttgtgcaatattttttataaatggattaagaaataaattccttaatatttatttaatttgaaatacacctatcatagtcttaacatatttaaatttaaagaaaaatataattttatgtattcacttttaaaaacatttttcaattttttttgttctacctttttgcacgaacacgggagagagttgtacactgtccaatttatgactatccacccattaagcctctcacattcacttccacaacttaacaacaaactgaaaacagcacagaacaatgtcccaacccagattcattgtcatgactttcccatgtttggcacttgttcttctgcttcacacccttctcccaatctgcaatggcctatcagttgtggacctcatcaatttgagtgaaactgaagtgatgaccaaaagggtttgcaccaaagcattggagagtgtttggcagagccagaaatggactcagagagcaataggagagttctggaaggtgtgcagcacataaagtacattagctatgggacactgaagagggacatggttccatgtgatagagcaggagcttcttactacaattttcatgcaagaccagctaatccttataataggggctgtgaggtcattactggatgtgcaagaggtgttcaaggcatcaaaacttgacagttactgtccactgaatggatgaaggaagctaggaaagcgtctcaagtggctgtatgttattcttcttaatttcctttttccatctaatcctgttttgtttcatttatgagctttcctctgtagttatggtcattgttgttacacttttaaaatgctttttatttactttctttgtaacatatggtatgactagcttgataatgaaaatgtttaactttttttgtttttgagaacatacaactgcaactcgacatattctttgggattttgatgcctatttgttacgaagtctatttaatatagagtttagtttagttatcaattgcagggacttcttcagtcccacattggaaagataaaattcttgtgtggggtttataaagtcttgactctactaataataaatggtttttgtggtgtggttgcctcaagcttctttggaagttgcaaattttaactacttcgaaaatcttagtaattttctgaggaatattttcccaaaagctgtttattttctaattcctattatattttctgcaacaattttatcatattccaagaagttgaaggaagtggatctcatagcaaataatattactgaaactttagtctttatttgagccgaataatattgtgtgatctacctagccaatctcacctaatagggtaaagcttttgtattcaactacttgaggctttgaaacaaattgattatattttgttggctttctcttttgattttagtcggatttcacagcaaatggttcatacagaacacccaacctgagcattcgtatcttatttattatgtaatgcgttaaaattttatttaaaatgaggctcctcacattgagtccaatccccttctgcaccttcatggctaggttgagttttttggggaaaaaagctgatttttcacatctggtatggagaaaataggaaataagattaaaaaaagatacataatgcaaaccaaatgtttaaaatcaatctcatcttggttttacttttaaacgcatggttttcaaaagtgagagctattttcagcatgttctaggaattattcactttttatgaactctctcttccttacgttatgtttggttattctcttgataagtttatggaatcttaatcaaactcactaggatcggcattgtgtaggggatttgaatagtttgcatgaggtttaaaatttttttttttgcagaaagcaagatatttttatagttggaggtcatgagacgttgagactaatctccatgaaagtagagaatcagttaatagttaacgagcaacttttttgccctacaagtgctactctatttgtaaaaaaaatatgaaatcttcatggtcatgggactaacatcacaataacaatgacagagttgtatttgtaagaagatatttcgtgtggtattatggtattacagtggggacttggttaggaataatatcataatatgaaagtgaaatgtgctgaacaaatgaacaatgaagcatgtgtgacgacgaccacccaggttggcatatgctaaaatatttcactgtgtgctgcattgcactaatggaaaataggtactgctaccccttcaacattgcacaggaaaaataattaaattaattggcaaaagatcggatataataattaacaagagatggctagcactaattagaccacatggtttcagttatgtttctcttggcaaagccttcacattgcaaagttagtaaatagccatgtcatgtgccaatgtcaaacttaaaaaactgagggctgtagatttgtgaagcttgacaaaatggcctttgaaagcaatattgatatgtttgttgaacaatagatatgtccaagcatgctatgctatagcctataggtaatggtaggccacttccaacaacaactatccaagtgagcatttatgctttggtgcccctaggggatccacactccatactctactcaagagcacttgtgggcctcatattttatagtgttagtatagaaagagtacccaatttacccaccctccccatctcagtctttttcaacaacaaaaagagaggggaaaggaaataaattatttttcaactctttactctttttttgtcatttttgtttaattagatgaagatttttattttatcatttttattggaaaatttgatcacatctgcattaactagttagttccctttgcctatctgaatttagatttttattttacaatataagccagtgttcctctgacagataatgaggtcagcaactattttctacactgtagctttttcttgttattatccacagcagcaagtgtttcactgtttcggcaggcaaagcaaaggggggtctatcaggcttttggaatgaaagctttttgggcctaagatgacagacaaaatatgatgatatttaaggagggatggcaacaaagcgatttaagaattgggtataatgcataaaattcaattaacaaatcttaaaactaagagacttaggaactaaattttatttttttagtataatatgtaattttaatgttattattaattattgctatagtttaatttagaattatttttctgttaaacaatagtcaccatatgaaattcttaatgttattatataagcaatatatgtatttataaaataatcaagtatttttatttaattgaatatgtcaattagtgtattatgattttctacttacattacttttgtaaaacttaattctaaaaataatgttaagttgagaagcccaatttgaaaaaattcacctttattgggccataaacctctaaaaagcctagagcctaaacctttgtgatttttctgcatctgaaacaatttgaaatttcaaaatttctcttttctttacgaggtcatcaaagcacaaagctaacaaattccctagaagagggtgcataaaactccaacctgtttcctctgttttttcccttgcaattattactcttttttattggtagaaattgaattattgaagtataaatgtgaaataaagtcccacatccaataaaaataaaaaaatttaacatcatataagtaaaaataactaaatcttaaagtttttaaattgctattctctttcatgtaaagataaaacacataaatctaactcttaaagtctcttgattactatttttcatctttcatgatataagtgatgatttagcctctagatttcatggtgattatagaagtgtaagtttattttaacttgtctaagaaggctaaaaagattttgtaacttctttataaaactcaagtcacacgagtaaatcgtttacaaatttgtaacctctttcatatagttttgatacttacttggtgatgttataataccctaataagctctactttcttcctgttgtaataaaaaaaattgttattcaaaattgattccaggttaagaaaaaaaaatcatttacatgataaatttcattaaactaacgtctcttgcatttagtaaaaaaattgattttcttatatagagttccaagttcaaatgttgtgaaccgaaaaaataaacatgggaaaactttctcaccttaaatgtttcgtgcttgggtaagattaattgaatcttaagtagtttttgctaattgaaagttaaatccttaaaaaaattatgagtttaagatttgaaactattataatccaaccaaacctagcacgagatgagatgagttagtacttgacattcttgtccgtaaaatgatattgaacgtaaacggtcaagtttcatatgcctaaaatgaatataaattttgtattacatcatctatattcattctattgttgcttacgctcctggtcatatgatatgattcaaacaacttgcttagtgcttctccatagggattgagtgtcatgcgttagatttccttaactaaatgcatcatttgaatccagctgaatgatgattctatgaaaaccactatttcaaacaataattagagagaaccaaatggcagatactccacatttcatgtttttgtcttgacataaaataatgccataacaacatcattttcgcataaatttattatttattaatagtatacaaagatgtatgtgaggtcacaccttcggcagtagagaattgagatcgtaatttaaagatttgtcgaacacgtttaacacacctaccacccgcaacccaccaactttggacttgtttagtaatgggattgataacctgctttatttttgttggaaaatatcaagaataaatttcccactttatatcattaagatgaatgataagaaaaataaactaagagaataagagaagaagaataataccaaaaaaaatttaatgtgaaaggaaaaaatcacgaaatcaagtcaaaaaaaatatcttcactatgaaataggattacaatgattttaatctcactcaatatgatgatttaaaatatttctcaaacactcaccaagtataatgaaatataactctcttttattgaagagaattacaaaaactctctcactcttaaaagcatctcacttgtttgctacaactcatcacaagttttcatttatatagttaaggggtataatttcacccgaaagtaataaatagaaataaattaattttcatattttcaagaatccttaaaaatgttatctcgatctttataaaatgaatgtgatatcagagttaaagatgaactttcaaaaccttgaaattcctatcttttatttttgatgcatttaatgttatcaagatttattgaatgtgatacttcataattatatagaaggatttccagtagttttatcctttctactgtattatttattgaggattggggactaagcaagataggacctttttactttgttggtctattaatatccaagttgttcatgcttattttcacacctaacattagcttattcaagattcttaataaaatattagggaaaatatcatgaaacttttatcaaaattgtttatttgtcgttgacgtttttggaaacatctcaatagtgacttgttactcaatcaatctttactagcactctcatacttggttttcgttattcctgttttcaaaccacatactttgactaatggactatgaatgaggctgcgtataaaaatacaattggcgtattcgagatgcaaattgtgttattggcctcttgtccttttccagatcagtattgagaagttcaggcaaggcttgtattgaatctgactctgacagatacataaaattcactataaaggatccgttcagcaaacaccgctataattaatggcaatgcaatgcaagactaaacatcgaagatgagtgacacaataaaaatagttgacccaaaaagagcacctatgttctagtgaagaatacgactttttcttgttgccactctttaccaacagcattcaagacgtacgttaggatattcaaatccaatgcgtcactgaggaacttttgcactcattttttcacgcaaaaacagagaatcatccagcacagagtcttgcaaaaattgatgtgaaacaagaatgctctgagcctaaattggatcaatgtgcatgctaaaatttagacccatatagtatggggaagtttttatcccttagtcgcttttgtctttttcctttcctttttctaagcaacaaaccatattgttttataatttgggcgaggtctaaattcgttttatcattgtaacaaaaactaaagaaattaaagcaaacgatttcataggctatttgggagctatgttttatgaggttaataacaaaataggaatctcttgattttaagaatgaacaatttttttttcactatgaaaggagtcctgaacattataattggattgggtgttaaggagagaaatagaaaggagacatttcactcgattggttcaaaaagaaataagaacgaaattgacaaattctgtgggttcatttgggaaattcttctccattgttcatgattggaaatgattttgtgtatcttctttttttttcttaatttctttttaaaaaatcaaataatttttttaaaaataatttctttattaaaatacttttactttatgataaatactatgaattaaaaagataaatatattctcttattttcttatttctcttccaaggattgtcgagatgggagaagattaacgtaaagaatttttatttttttattaaaacagcgaaaatatagtgtatatatataaaaggcacaaatgggtgcccccaatcaattacaaagtggataaaagtccaacaaagatagtatacctcggttacaccatattaacaaaggagagtaaatatagtttaaccaaggccaaaaacatcactcctagccacactccagtaaatatagtttaacgtgaagaatttgattcaacttgtgagagcttcaccccttaagttaattcaccatatagctcaaatcggattagttggagaacttaattaccctgattgccctttcttaaaaatattgcagaagcaccaaataataccacaatgtgtcgatgtgtttccgaaactagatgatagatgggtaggaatttttttattttctttgatgtattgaaaaggcagaaagaaacacaaattttagtatttaataaagcaaaatgcacacatcccccaaacaaaacaagccttattcaacccaaattggtttcatatcacagaaaccaacaggatgccgccttcctccttactggtcccacccactcgaacaaaagttctacagaaataaaaatggctacaattcttctaccacaaatctgaaaagtctaacaccaaaaatcaaaaaaaggaaaattaaacaatcaaatccgattgataaaaccgatttttgtctttccctcactcacttttcagttgatcatctcaatcacttagtacctgtagtgagcaggcttgtatggaccctcaacaggcacactgatgtaatcagcctgggacttgctaagctgggtcagcttagctccaagtttgcccaggtgaagtgcagccaccttctcatcaaggtgcttgggcaaaacgtaaaccttcttctcgtacttgccggtactcttctccttccacaactcaagctgagcaatgacctggttggtgaaggagcaggacatcacaaaactggggtgtccagtggcgcatcccaagttcatcaatcgaccctcagccaagacaatgataccggtgttggtctcagggaagacccatctgtcagtttggggcttgatggtgatgcgcttcacgccggggtagttctccagcccaagcatgtcgatctcattgtcaaagtgaccaatgttgcaaacaatggcattgttcttcattttcctcatgtggtcaaccatgatgatgtccttgttaccggtggtggtgacaaagatatcagcctcagaaacaacatcctccaaggtcagaacctgaaggccttccatgagagcctgaagggcacagatgggatcaatctcggtcacgatgacacgagcaccagcctgcttcattgcagcagcacaacccttgccaacatcaccatatccagccacaacagccacctttccagcaatcataacatcggtagccctcatgagaccatcagggagagagtgacggcacccatacaagttgtcaaactgttacaaaaccacagattaaaaggttaaacaaacaaaacacaagcaacaaagcaaaatccaattataatcaactagatccatgaccagctagtataatgtcctcaaaatccaatcacccacttcttactttcaataccctaatcaataaacaacccgtcacaaaagactcggtttggatcaatgtttgcaaaaccaattttgaatgaaaacgatttcgagttaaaattgattttgaaacaacatgatttatgtttgaacatttttttattttaaaaccaaaaacagtagtaaaattcagtataatttattttatcctatccaaaagtagcttcaaatcaaaatgtgcactcagaatcaattccttatttgtgtaataaaacatgtgaccatttacctaaagtcacgttagcaagcaacttactaatgttctgacgtttcaacacacagatccaaacacactaaaatagcacccaataccgatccagacttcttagaggacattagtcaaacagttgacaggttcaaaacctcatttcaccaatggcacaaaacccatccaaaaacaacagatccgaactcaatcctacattttaacacaaaaaagacactagatctgggggaaaaagagacattaccttgctcttggtgacagagtcattgacattaatagcagggaagagaagagtcccattcgcctgcatctgatagagcctcttaactccagtggtggtttcctcagaaaccccaacgagacgctccttcatcttgcggtacctggtgggatcggtcttcaacccatctctgatgatggtaagcacgatctgaaactcggcgttgtcggtggagttggggtcggggagttcgccggtcttctcatagagctcctcggccttgacgccttcgtggatgagaagggtagcgtcaccaccgtcgtcgacgatgaggtcgggtccaccaccggggccccagtcgagggcgcgctcggtgcaccaccagtactcctggagggtctcacccttccaggcgaagacggcggcactgtcgcgggcaatagcggcggcggcgtggtcctgggtggagaagatgttgcaggagcaccagcggacctcggcgccaagggcggtgagggtctcaatgagaacggcggtctggatggtcatgtggagggagccggtgatgcgggcccccttgaagggctgggaggggccgaactcggtccgacaggccatgaggccgggcatctcaacctcggccagctcgatctcgaggcggccgaagtcggcctgggaaaggtccttgaccttgtactcgcgaccactcgtggttttctccaccaacaaagccatgctttacgcgctgagaaataacaggactagagaaagagagtggagggagtggtgaggaaacaatcagactctgtctataaataaggaaatgggagcgggagttggtgagctcaactagatctgggtcgacccagccttacctccttccaattttcacacgcatttcatttttcatcctgaatatttctttttcttttatatgttttttagtattctcccaaaaagatgctaaatcatcataaaataaacgcctaaattaaattattattaggataaatgattcattttgttttgcaagatgtgatgagttgttaaattagttcataaaaaaatataaaaaaaatattttatcgttaagttataatgttaaaaattaatttaataataaattatattttgtgagaatctatttatttgtccttattattattttaattgattgagatttatatatatatatatatatatatatatatatatatacttactttttgtgaggttaattttattatgttttcactcttaaacattgtcctgaatataaattttgcgtacgagaaaaaacaacaatcagctttactgtactatgaaaaattatacttcaaacaagtctctcataagaatgtttatggtctcatacagatgaatattttcacttcgaatacacgtaaaactaatatgaattcacacaagtgattaaagatctaaaactaacttttgtcttcttttttttatagatgtgggtttcattctctatcatgccactaaaactatcatctaatagattctttgacatctaaggactaattgaataaatacaattaagtaaaattgtctatgatttaggcctgtggaataatccttgagtaagcctttattgacatcgctaacaagtagcatgtcattaaggtttcattcgatggtattgatcaggcctctataaaattttgtacattttaatatgcatcaaatgagcatactggtaaagatttcggtgctcaagttaatagttggtaaagtaaaagcattatatgtaagattttcatgtacttggtaaagctaagggactatcggagattgttgataagcatttaaaaaactctcaacaatcttctatctgcctataaagttttctcaaaaagcatttaaaaaatttataggttaattagagatttgttaggtaggttaacatacatgtaaagatttttctttttttggaaaatacatgtaaagagttttgtaaaagtagaacttgtgaatacgtgatttataagacaattcatattcctcccaatcaggtaattttgtgcaaaaagtcttattaagttggtgtgtaactgtatttaaaataaattcttcattgatggagtgggtgaagttcacgacatcgatcatagacagattttttttcttccattctaatgtttaccgtgtgattgtggccacaatcaatttgtaaacctgtgacaaactttgtctcttggcctacgacagaaaaaaggaagagctgaatgctgatggttgttccatagccactaaagtgagcatttgtagtacccatgtcttttggcactgtatgtgactcagctagttgcgctggatgggttccattccattgatttttttttttttatgttaaaattttcatttagtattctaaactcacttgacattaattttgtcttacaattttttgtgatatcaaccaagtttctctaaatattgtaaaacacaaaatatttatattccaatcttcaatgtttttatttgacattataaatatttaaaggatagaatcaatgttaatcaagttaacataaaaaataaaaaattacatagcattcaacatgtaggtatcaaatctatgttataaaatgtttattagatagagaaaaatatttgctaaaattttgataattgtgctatgtttatatgttgaatgatgggtaaaataaaatgacgcataattaagtaacataagtaaaataaaaattaagtttaatttttatgaattatcaatataaaaaaataaaatatattcctaacatttctctttcctctattttacattcattttattttcttaatttttttcattttgatatcctttaatataataactaatactgtaaaaaaaatgtcattttttattcgtaaacaacccggtcaaaatataggtttaacaattagtcaattactatataaataggttttgtatttgaatatgttagtaaaaagtagttttaatatatcttattccagtaaaattatcaattacttttaataataaagtcatacaaatttgtataaaactattttccccctacgataaaagttgtttcgaaaaaaaagtaagttggaaaaatttattgaagtgatgaaaactatttttatggttattttttatcacacaaattaattttggaatcttataattagaaatggttgaatttatatattggttaactttattttcttatttcgtccacagtaatgaattgtttcaaacaaaaaaaaaatcaattaatatatattttataattttactattgaaaaatacctttttcaaacaaatcactaatcacttaaaatacaaaaatatattttgatgagtgaaatatgactgcagaagtcaagtcccaaaattttgatgagtactactacaagggagatggggtcatcatagttgcttctgatttgctattttcattggtgtatgacctattaactattaactacgttgtggattgccaaatgaaaatatcagtgaagcaaaaccctcctcctccagcgctatgaatatgcgtgtgtcggtgatttacttgtacattttttgaaaatgaaagaaaacacaagcaaagtgaatgtgcatgtgatcaaataaaggaaacaaaccagcatacataaataatcaagctctggtccccagtcatggagattaatttgatgaaccgaccaaaaatattggtacagcataatcacaattattgagaagatatttttattttatttttaccgaatcgtcgcacgactcggcgtgttgcaaccgcattaaatctttgtgttggtctcaccctgtctttttgtggatgatcgatcctcttggattggtttttataaaactcaacttcccatcggtgttctttagtaattggagtatctttggatgttcgttacattttatgataaatttaaatgatccacaatcactaactcaattttgcaaagcaggattctgaatgtttttgtaaatctcgttttgtcctaaaagttcgtctataacaataaaacaaacatgcacttggttgtttttaaaattgtctcaaaactctgttataaagaaataagacctaaagatattttttacaaattttaattcaaacatgcactgatacatagagatatccttagattaatttattttgttgataaaaaaaatggataaaaatttccatgctttaaatttgtcattggtccatctgatcgactctatacatcaaacttgagtgttatttgcatacaaaaggaaaacatcagagacatgacagagtaggttgcattggtgtttagttgacctgattaagaagttacacacaaagtgctcctctatctcctcttcaaggtcctcctacctatagtcttcttgtacctcttattatatggattaattagtgtagaattatttcaacttaattaataattttgaatttaagtcatgagaatgagtatcaaaattttttcacctataaaaatcgaatgtgcttcaaataagattgtctctaataaataatatgtgtttaatctatattatttttatctgaatttataaatagaatttcagtattttttaaagatgaaattatcataattaattaaaagatatttatgttaattaaatttccccaatcttgaaagatattttatattacttttttaaggacattttgtattagctttgcgttaccagcttgctgcataagtacagctcaaggctttgaaaaacctatgtcggttggttcctctttaaagaaaagagaataaaaataacaaagaaaaaaaagtcgccttccatttcattcgcattcatagtaaaagagtgagcgatcccgggaaatgaattaatatacgactaaaaagatttgagaattataataattaataattaataattctttttcaaaagtaaagtacagtactgcaggaaacatgagcatgttcatagattaaaatttaaaagaatattatcagtaacaaaaaaataaaaattaacccatgcatccaagaaagaaatacccatgtgcttcagttgtccgctgtctgagatgtggtgaccttttttcaaatgatcataatagttacttcataatgacgacatgcatcaaactattttttcttcaaaaaatatattggcaccttttcactcggataattgcataaattattgttttaacttttatttgggttttctatttataaaaagggagatttttttaagaaaaaaaaaatcaaatcataggactcagatgactcgcccttctattttttcatgcaaatggccgttccaactattattactaatatgtaattattgaagcaaaacaattcaatgaccaaattaatgttaaaagtgaaaacaaatagatcaacaaccttctcgcgtagcttgagtagatcttaaaattggatatttgctcaattaatacgcttataatatagtagtagtagcctagatctagatgcagtttgtcccgcgttgtaattaaataaaatatcacggaattattatgagagcattggtgagcatgacaatttcaccggaaaaaaaaaagtgagcataataaagtcataaattaaaaactacaggtaggtaattgaggacttataacttggaagttgggacgtgccaaccgcatataacatacgcgattgaaagactctttacaaatggctttggcaatggcaccaatgcccaatgggagatttaagtcaagcccaacatcaacctctgaaattatgaattatgaaattaaaatgcttcctagtaagtgaactagttgcatctcatttatatcataaatttcgaactacgactttcttggccatgttagtaaagtttgggggattgttcaaaattggtggagtggttcagcttaatctccaaattatttgttctaagttgttttggtaggcaggtttaattttttcctgatcctgggaaaaaaattattgataccatattaacatctcttgacgatgctacgagatttctcatgattatagaactgagtagggtggcttaaaaggttttattttaaatataatttcaccacattgaattgggtattagtaaactggttactggtatgcctgtaaagtggacaatgataaatgtttttatagaagttggtatggattttaaaatagctcatgtataaaatgtgaaaaaggaaacgtgaactaaaatgctaataataaaagataaagactaaattaattaaagttaaaggataaaatgcttgttacatcaagtcattttaaaggtgcactattagaggctgcacagtaaaagttaacactgatatatttttaaagatgttcttagttaaatagcttttgacttgatggggtgaagacacaagaggttgttgttgcgatgtgattttggctgaatatgcatgcctgctgaacattgacttcattgttaaatcaaaattaatcccatagacctattgtattatttaaggggatcaatttcataaatcaaaatttattggttggggaaaaaaacaatgtttagtagttcccagtcatattcagaaacctacaaattaactatcccccatgttaatgaagcaaggtgtgggggaaggaaagagtcagcatcagtgaagtagagaggggggttggtgattttggtgggaataaattggctatattgcccccaccaacctcgttgctaccaaataccaacaacactgactcactgagaattgggaaagaaacttaaaaccaagtcttgcagtgacgtacatgcagtgtgtgcatcacacattcaggtttccagtcaaattgtagaacaaatgaatttcttgctttaacttaagttgaagtttaagaagtgaagctgatgcttgtttttgaatgaaaagcctttgatagtttgatgtaagcattttccaaatttaactcttcccatgcttgacagagccaattaagctaactggtttgataacaagtaaacttctaaatctatgagtatgagtgcatgcagcacaccttttaaacacaagccactgttttgtcttttttatcaacagaaagagaatcctactaataacactaatcaagatcgctgctcttttctgtttatttttcttaataaattaacttttgttttgtactcctgttaaacaactgctctatttgtttcatgtgttgcattaaataacatggttttattcacatctacaagcaaaatttcctaaaaactgtgaatgatgtagaagcaagtcatttatgttttgaaattcacgcattggagtttctaacgcccaaccaaccaaacggtaatatgaatatcgtgtttggaacaaattagaatttaggacataatttttcacatcagaataaatgttaggaatttttgcttttacgtttttcgcattaaaataatgtgatttatcggttgttcctgaacaataaccatcgatgtaattataaaattctaatttgtcctatcctggggcgtcaacgtccagccaaatgcgtaacatttattctgatgtaaaaaattattattattattatagataataaaatcttgttcctgaacaataaccatcaatgtaattataaaattgaatcttagactcaaaactagttattaatctggaacaatgtttactcaaaactagttattaatagtatttttaagttaatttgaaatttttttttcggcgttaaacaaatactagatgtttatactacaaatattgattattgattataaatttataaatgttaaaaaaaaaaaaaagagaaaacaaagaattgaagttgtggttggtagtaaaccagcaccaggcgaacaagtggacacaatttacctacaagtaactaaccaaccggaagcacaggctacaacggtcctttcacacccggtctcaaagcttttaaaaacgaacacatacgcactcacatttccattccacctcaacaaacacaacaacactctctcttctcgctcttggcttttcgctcttcactcactctcattcattcatttccaccgttcatggatccagtaagcgtgtggggtaacacgcccttggcgacggtggatcccgagatccatgacctcatcgagaaggagaagcgccgtcaatgccgcggaatcgagctcatcgcctccgagaacttcacctccttcgccgtcatcgaggccctcggcagcgctctcacgaacaaatactccgagggcatgccgggcaaccgctactacggcggcaatgaatacatcgaccagatcgaaaacctctgccgctcacgcgccctccaagccttccacctcgacgcccaatcctggggcgtcaacgtccagccctactccggctccccggccaacttcgccgcctacaccgccgtcctcaacccccacgaccgcatcatggggctagatctcccctccggcggccacctcacccacggctactacacctccggcggaaagaagatctccgccacctccatttacttcgagagtctcccttacaaggtaaactccaccaccggctacatcgactacgaccgcttggaagaaaaagccctagacttcaggccaaaactcataatctgcggtggcagcgcgtaccctcgcgattgggactacaaacgtttcagggaagtcgctgataagtgcggagcattgcttctctgcgacatggcgcacactagcggccttgtggccgcgcaggaagtgaacagccccttcgagtattgcgacattgtgaccaccacgactcacaagagcttgcggggcccacgtgcggggatgatcttttaccggaagggccccaagccgccgaagaaggggcagccggagaacgcggtttatgatttcgaggacaagattaacttcgcggtgttcccttcgctgcagggtgggccccacaaccaccagatcggtgctctcgccgtggcgctgaagcaggccgcgtcgcccgggtttaaggcctacgcgaagcaggttaaggcgaacgccgttgcgcttggaaaatacttgatggggaaagggtacagccttgtcactggcggaacggagaaccatcttgttttgtgggatctgagacctcttggattgactggtaatatatataggattggatctctaccttctggttttgatttgttacaaatgtctataaatctgacttgttcgttgtgtgattgttttgcagggaataaggtggagaaactctgtgatctctgtaacattactgttaacaagaacgctgtttttggtgatagcagtgccttggcccctggtggagtgcgaattggtaacgatcttacttctcttttatatgctacaatacaaatcttgctttactaactcaattggaaacaagatctcatttataagattataaaaatgatttccttaggctaggactatatcctctctctctctctctctttttcttttttatcatcgcagaacttagatgaattttcttacgtaattttagtactgttctcttatcagagttcgaaagtaagttataaaatttctattgaaggcttgcatatttatataagtgaaattttaattttggttggagaacaatgtccaaaacaccaaagtgattgcatctaagttttttggattttttaatgtatttgtattttgtacaaggtatcttagtaagttgttgtagattagtattgaaagagatttcattgaggatgtgttttttagtgctttaacaaaggaggtatgttagttcgggctaaagcttgcagactgcctttgttaaagaatttcgagttgttgtcgtgcaatatgattggcaaatcaattataaactaatctgttattttgtttttctgatacttttccctagaaatgaattattttgatgtatcaattaccaaaatggtttttttgtgcccccgtttctgtatttttctctgatgtgttagataaatgtgagtgcccctgactggagtttctgtgaacaggtgcccctgccatgacttctaggggtttggttgaaaaagactttgagcagattggtgagttccttcaccgtgctgtgactctcacactggagatccagaaggagcatggcaaacttctcaaggatttcaacaagggtctcgtcaacaacaaggctattgaagatctcaaagctgatgttgagaagttctctgccttgtttgacatgcctggcttcctggtatctgaaatgaagtacaaggattaggttcaaccataccactttctactaaattgtgtcactcaagttcgacacaaagtgcagaaatggagaaaaaggaaatatgtgtcttcctttcctgggagtgatagggtttatcgccatggtgtttcaattcaaaagtttgaagtttctttgtctttgatttcatgtttaattttgttagcctgattgatatcatattttttttcttatttaacaattgaaataatacgtgctgcctttctttctttttttttcctcgctagctagtagtatgtttcatgatttcatcttctaatattgctcaacagaacatcttaattcttaacaaccatgagttttagtggagttaagcaaaagaaaaagttattctaataaatctatcgtctttcttatgcctcaatgtcctatgcctctcccccctatttgaaaaccaaaatgctccatgtctaattgtgataagctgacaatacccgtctggcaaattatgaagtcaacatttttttttagctcagcaataacaaataatattaattgcacaagtgctaaaataacaattgttgggcaccataaaatctggtccctcaaagaacaagtgttgcagcagtaaaactgcatacaccccaccccacctttacacgagaaccataagataaaaataaggaaacaccagggcacgcatcttttcctatactctcaccaaacttcttgcataagggaaaagatgcgtgacctctgcccacataaacgtaaatccaccatagatacaaacaaactaaaccaaaacctacataacaaaaccactgtttgttcacaggtaagagaggcatgtagctgggttcgtttgccacatcagaaaagacacaaatcttttttttacgctttgagccatgaccaagtgaagaaaaattggttggagaacaactgacttttgtaactttaactcaaattcctcacgctcctcttggaaagagattatgcatcaagagttaatcggtagaagcaaaaaattaacaagacattcattaataattattcagtgtgacttttctacatccaacatctttttgaattttttcccaatcccatatctgcctctagtttcttacttttgctcacgtactcaatgccaatggactattaaatggattcaatgtaagaaaacctgctaaaagccattaaaatgtacataagaatgagcagctattgcattgtggttgttgaactaatttacttgatttaaaatttcaaactgaaagatccaaaacaagttaaggcatgcaatctgaatcagtcactaaagggctcgtttcacccctcattagaggcttaggatttttttgagtcctagaacacacatcttatctcaataatgatttctatcattgccagaattacaattaaaaactaaaatataatcaattagattgaattgaacttctacagaccccaaaggcactcgatgcattttcactgtatgtggtttgtctttctgtactatactgcacgcttagcaaaataatcagtaacacatgttaagagagcttgcactttatttttatcttgttgacgggtttgttgtcattgaaaacacattatattcagaggaatttgactcaacatgttcaacccaccaattatcacatttaaacaaatttaaatcaatcgcaaatcatatatattcagaattttacatattaaatatttcatatcgtagttcttcacttcgttactagaaagtcaaaactttatgtgtacaatattcttacatcatagactacaacatgaagttttaagttttaacatgtcatgtaagaaacttaatgttaacaaggcttgaaatatgattagagtaagaaacttcccagatattataactaggagaatggacgtgttaggttttatttctccttggaatcatagtaaaagtacacccaaagaaagccacttgttggtttctttgttatcaatcaatgtcagagataactctcaaagaagccctattttagaagatatatcatacaatttagaataggctaacaatcaattagaaatgcaaatgagctaaattgcaccaattacttcaatttctagttaagagggccttcacaactattggactcgtgacgtaatgcttgccatctgaccatatcagttttccaaacgcgtagttatttgtggcctttccttgcatggccttgaaggttaatttaaagctcttctcttcaccaacatttttgaacttcaagatgcttggcttcacagaaacggtgattccatacgggttttgaacatgagcaatgtaagtccctggagaaccaacatttttcaatgtccttgtaactgtcactgacccagagagttttgggactgtgattgagggatagttcaggttgaggagactaaatttcttgcggcatttatatggaccttctgtgaacactgagatctgtgtctcgttgtatcctaaagcacataagaagttgaggtaatcatcaattgttatgtcataaactagcccgggatccattgctctgtttggttgaacatgccctgccccgtaactgaatggtgtcgccttgccatcagtagcattcagtagtggctccacctcattgtctagtgttgtagctgaaagtagcagaggacaaatcatcaatttttgatagctacttttacctcactaatcaaatttgctttctatatatgtatggacaaaacttagatacaattccttagatactattggtgtcgttctccaattagaattggagtttcacctcccctcataatcttttaagacataacttacatacttacatatagtttcttaggtactgtaatcgttttttttttaaaaattagaattagagtttcaccttgcacaatcttttaatgaaaacctttattaacactagcagaatttaagaaactatatctaagttattttctatatatatctaagctttatatttctgggacattttattgtagattggcttgaaaaaaaaaaggatttgaagcatgagaaaccatgaagaacatctcactcacctgtggtcatgattgctgatttaattgcagcggtactccacgtaggatataaggctctcaacagtcccacaatgcctgaaacatgagggcatgacattgatgtgcctgagactgagttaaacggaatcctgcgcttgtcgaacacttgattggttggtccttgggcctcagtataggctgctataactgacacgcctggtgcagtgatatcaggctgaatatattggacaaattaagagttcttagatatctaacacattacatcaaattacaagccaaataacactgtaagtaatcacacctttaggatctctggcaccatagtatttggtccttttgatgaaaatgctgccataaatggggctggcttagtatccaattgagtctttggatgtgtaatatatgccactgggaacctaacaatacataaatttaaagtagtcaagttcaagttgaaaaactgagattcatgattatcatattgggatctttgtattgctaaaaaaaataccaactatcacaaattataagtttaatagcaatccatatattctgattgcaaatatagaatggtatgtccatatagtatagtgcaaaccccaaagtaggcatagcttaaggcatggtattaattattattattaatatgtggcagactagagtggtagatatcttacttggttgagttgatgtaattaaagacagcactaccatcagtaaaattgatatgagaagcaggaaggacatgaggatccgctataatttcattcccagtagtcttgtcattagcaaggaccattcccacagcaccagctagaaaagcttgctctcccttgtccactcttgcatttattcctcggagacacaccacgatctttcccttcgccttgttgggatccagggtcccattctggcacagcaccctgcttagacataaattttatttaccatatatagtgcaatgttaattatgtcaatcattcaacaactgatgactataacgagtttcatatttttgatacttacgcgtcttcagctcttgcactcgccaatttagcatctgtggctttaataattggatagaacttgtgtgccaattttgtagctgataagctttcccccttcaaatcaagcaaccgagattatggtgtcagctgatagtgtttataaattgcaaatcctcgactggccacatctgtatttggaatacaatttcgtacatttgtccaatatttttttcacaattttcgtaaccacaacacaactgcaactacaatcacactttaaatcatgactttcacgtactttcctgttattaaataacatggttatgttgaaaacaaaagaaaaaaatatcaaatttaattcatgaatctttcaactaattaaaaaatgaccaatcctaactagttgcagaagctattaattaaatttttaaaaaagtatatctttctctcttatgactcacataatttatagtccctatactcaaagtctcacataatttatactacaaaatcttaggtttaatttcgtacctattgttaatgtttcctaatcgaaattagaatttcaccccgataattaaaagtttacattaaaaaattacataaattaccgaaataaaactcaaaatttagtcaaacaataatgtaagcactaagcagcaactaagaagctataaacaaagttttgataaatagttaaatttatcctccaaagtgatgcggtgataaattagtctctaagatgataaatacaaatttaatccgtaaaaaaatatgataaattagtgggcatacaaatttaatctgtaaaaaaatatgacaaattagtcgcactttgtacctattgagtgattaaatttgaatattcatcggaactaatttattatttcaacacacttgatgaatttgagtatttatccgtaaagtttagtcataatttgcatacatgtgtgtgtgggaaagagacaacaaaccttgaaggtaatatcgttaccaaggacaacgtaagtggggaactgtcgatccatggtgctggcagcaaccgtaacatgccagggtgcgagattttccgcagtggcttccgcgggcccactgttgccagcagagcaaaccaccacaacgccacgcttggccgcatggaaggatccgatggcaacactatccttgaaaaacgtggaggaagagccaccgagcgagacggagaggacatcgacgccgtcgtggatggcgaggtcgaaggccgccaagatatcagcgtcgaagcactcctcgcctccgacggggggccagcagaccttgtaggctgccacacgtgccattggtgagccacccttggctgttccctggccctggccgaagacgctgacacgtgcgaccatgttcccgccagctgtggatagggtgtgggtcccgtggccctcgttgtcacgtggcgagtcaaaggaggagttcagtgggcccgccactgaggcgtagcccttgttgaagtaccttgcccctattagcttcctgcattcaacatctccacttaacgtttctttaatttttcaaaacaaaatcattgaaagattggtctggttggtgtgaaaacactagtactataaaagaataagataacgaaagaaacatgtctgcgttcaaaggagtgcttaaccctttcattgtagtattcacctaataaagagtgccaatttaaaggcatatgactacagaagttaaacaattagataagaaacattttatttatatccattataaatgactcacaaaatgttaaatagtttaattccattctaaggaagatggtacctgttgcagtgaaaagtatgatcaattccgttatcacagattcctctccactttgatggaattggtcccaaaccttgctcactaaagctctttgattcaggccaaacacctagcgttaatgcggtgggagcaaaagagatgatgagagtgtggtcaaaataagataagtatattgtaaaatggagattctacttctaccccttctccctcaatctcatccaaatccaaattggcttaaagctagcagcatgatgatggtcctgtttttagttctcattgcccccacccacttttcacgcctacagtttggggagcattttgaaaatgatgctgatgtatgcacatttcaattttcttattggtgactttatcatcacttccttggactatccccaccttggcaccattcttagccccacctcacagaataagctcaccctttttattttagtcctatcgtaatgaacacaagtcataatatattgctttgtcccaatccaactatgatttattaccaaacttatgcctccaaataaatgtatatactaaattttatgacatatttgtaagtttttaattatttaaatgtaatgatctataaaccaagaatcgtaacaaaattctaatgtatataacagacaaatgataagatgcctaattgcccatattgcatttgtaaaggtggtccgtttgtgataaaacaactgaaagtcggccactccatcatttatcaccaaacattttctacattctattctaaccacaaaaagttttccaatttctttagcagtaattacattcacgtttttcgattttggtgttaatttattttttgaaacagaatacctttcagccgaaaaagtcaataattaatccttgaaaatattcaaattcatgtaaataattgatctctttcaacatatctttttctatacacacggataaaaaatcaaacttttaattatatgcttaataaacaaaattatttatcaatcgtattacaccattacaccatgttgattcattttattttggtgttaattatggtttgagtataattactgatgcaagtgtagttataactaatcacacgagattaatgcaattagtctatttctttaagatggttcatgaaccttcatacttagggtgtagaaaagaactagtctaacaacccacaagatttaaattaataataaactaatgttttgaaatcaattttttaaaatgatcaaactctggaaacaggttggtggggggggatagagatacgataagataattttgtgtgtgttccacatgcgtatataagtcaacgatctagatcaaaccattatcataataataataatcaaaccccattaattccaaggtgttgctgaccactttgaaaagaataacaagagtttttaaacacaaatcagtaaaacgtacctgtatccaggtttcctatgatgacaccctcaccaaatctagctttcttccagattgagctggattggatcaccccattatgctctagctccatgaaatcccatgatcgagtggtgtgtagctttctcccacggttctcgaacactgacaacactttggggtgctctaaaagcaatttggagaaaagggtaggtacacaatgagataaaggaaacacagagaatagaaaacagaggaactaagcagaggataaggttcttagttcttactagctatctcaacagctacttcttcgtccaaagttgcagcaaaaccattgatgtgccttgtgtacgagtaaaagatggagtctttggctgtattagaactacaaagaagcaagctcaaatcaaagcaaggtaaaaaattgtaccacttgagatgttataaattataattgcattttttgttcataccttcctaagaaagatcccagaaagtcatggtgggactgtgtcacttgattgaagtcaactgaggataattctgggccgtgtgagtgggctcccaagtacaccacatatgactacaattaaaatggtgcactgcagggattagactagaccacaaggattatttatctttttcaaggttgcaaattgcaatgcctcacctttttcactgcaaagctgggtctgtgcaatagacagactagaagaatttggagcagaaagtggatggaaggacttggtggcctcattgctttgcctatctaggaagccctcctttgctttttccttgttttgaatgtaacagaaacacaacctttggttttatagggtaacagtccttgtaaaacataaagtgactgcacctttgctccttaggttaaaattatatttaatgtactttcttgccatatcagattcatttcactaagtggttttaatacttttttaattttttacttcagagctacctaaggttttatttacataatttcttttacatggtattaatctttttttgtttttaccaatagtagaatttataatattatattagacttaaaaatagtagtattatacagaatcacactctctcaaattaagcacataggagaaatcaccaacgtgacagctaataattgccaaatataatattaacaaggtggttttatataaactctggttggaccccaaaaagaaatacccaaatatcacttttggactattgcgggtttgcgaaaaataacaaatgcagtgcttatttaatccgtgtgagtgtgtttcgagctaattaattagggcgaggattgaagaaatggatatttttaggtgatgtttgttttaagatactggatatatttgggaaaaaattgacaagttagctttaagtaaaaaaatagttaatttaagtagaaatatttaataaaattagttatacaattagctgtaaaataaaataaaagaacatgtttatgtgatttttatatattttttatttttttttaaatatacttttagttagctactgtttttaatttctgttaattttgaacttttatcatttttaagatcaaatatttattttataaaataaaacgacagtataaataatttaattattaaaataaatagtttaatattaatgatagacttttattaaaatattaatgacaataataataatctgtaaattattaaatcaacccttatttaaagtagtgtttgataaaaattgagttattaattatactaaatattttttattagctcgcaatataatttttatttagaatgataatgcaagtttatcgaactctataaataaactctggttggaccccataaggatatttcatttttggtctattgcgggtttgtgaaaactaacaaatgcagtgtttatttattacgcttaagtgctaaaataattcaaccaagctaatttattagggcgaggaatgagggaatagaagttacattttttttatagaaataatataagttaaatttaaagatatgttcgactggaatgtaatattttaaaattcaaatgattacataagtggaaatagaaatagaagttaaaaattggattataagataatttctaaatttgttttatagaaaattaacatatttttcctttccttagagctaaatataaaaatgtattttactgtagttcaacaatattagaaatattttttaaaacttatgccaaagataaaaataacatattgtataatttaacaaattttataacaaataaactgtgaaaaaggtaaatcactcgtgtcccttcctatatgtctttctttaaattttagttaaaaaacaatacttcaatataaaaaattaaaaaaagttactagtgttaaaagggaaaagaaatttgagtactatgttatcttttgatatgtatatataaaagggaaagagacatgagacaagtgaataaaacagataagttgaaggtgtatgttatccttaataatcagattgggacttgaaggttaacatcaaatactcttcagaaacggcctcgtgtaattattgaaagtgtggcagtttaatgtgattatcaatttagctaacaagcaagacaaaagaaagcattattgcaagaagactataactcaataagtatatataatgctgtgatgagattcgcaattaaaatagttgccggccatagtcatatttatgcttccaaaaggccactacttggatgaaaacctccacttaatttaaagaccaattttctaaaaccatgcgtttatttatttataaaacccctacgcggtaaaaataaataaaaattgctagattttgattctgccttctgaaaaaggaagtgcacattagcatattaattaaatattttcttccttctattttatttgatattaaactcactaatagcgtgattggaaccctccaaaaacaatatatatatatatatatatatatatatatatatatatatatatatatttgattaaaaatgttgaaataatatatatatttttatatttattatttcaaaattagaatacaaataagttgttacatccaaataaaaaataattataaataaaagtataaagatgttaatagcatgtgagactcattctaaatttttaaatagtgtaaatttgtacagtaatatatataaaaattaaactaaaaaaatttaatgagatttccaaatgtagtgggacattataaagtccgcttactactagagtgagttaagaacaaaagaagaatatactcttcaagatgctataatacaaaatatccatattccacatttatccaagtatctttaagagttaaggacactaaccacaagtatcaacatgtgtgactaatgagtgcgaggattgtgcaacaaatatatgaacatatgacaagatggtagaagcctggtctctcctttctgctggcagattaaggtgtggcccagtttttggtctattgttgctatttcttttctgcttttaggggcttatcctagccttagacttgatatttgtttttctaagaattgggctttgatccctcttaggccagtcagtccaaattagggctattgcttcatacacttccagttatttcctgcacaacttttttatcttatgaaatagtcaatccaaaatgtaaaattatattatggtatatttaacaacactaagttagtactaatatatttgttagaaagaatttgttaatcccattagacttagtatttaacaagcattttaatttgtgtgttgcttaggataagtgtttcttttaaatttattatataattaaaatttataataaataaatacctttaaacatgtaaattatattttaaattcacaataaataaccattggcaaatccgtgaaaaacaggctattgaaatttaatcaagacataaagataaaaaagtgttagattaaaagggtagaaaataaaaaaaatatagaatatacaaataaggataagaggaagataatttgagacaactgagagattttcttaacaaattgtaggggcagtgtgtggaatgcacatttagagaagagaataaacaaaatattgagaatatctaattaagagaatgaaaaaaaaaagaatatcactctctaagttgtctattctaatttatattataggaataaataaataataaaaaagtccaattaaattaattcctaataaaatttagcatatcaatcaacatcatcttgcgttttttcttgtttttttttttcttaattaaattgtatatacctatccatctttacagatgattgtcagcttttgcgaggtgggtatgtaagagccgtagttttcggctttgcccatttaacatacaacctaggctaataatttattaattgttagtctctttttaaaaaaatattattgttaatcattttaattcaattaacacttattttttttctaagctaattgattatattccggttttattcttcatcttcttgcccttcctttttcctttaatttccctcgaaatcctaaacacactctcttaactgtaaatatcacgccctataaagacaaggatatacaattattttgacattatagttggaaataaattttgctacaacaatcaaacatataaaatactattaagcaagtatcattatttccaataaagtattccctgcagaaattttgctccagagagaattaatcaaacaggatgtcaagcagaacatacatatacagtgtgtgggttctcggtaggactaaaccccattggccattggatggtgaaatgccaaaaagtatgacttaatttgttgcactgaaagaaaggcatgtgcatatatgtcgtttggaatatattaattatattatatatagagatgtctatgaagaggacgacgtagttgtgaggagaaccatgtcttcttttcaaatgggtagtaaagacaattctcatatatggctccaccgagcaactaccatatctttattccttgctagccctagcttttgacaaaagcgatgccaataatggttatatgcaaaattagaaagtaacctaaccaaccccacacttgtaacgtatttattgattaatacaacattacgtgcgattttctgttttacttgtgcatgcatgacgagaaaataaccaccttagttcaagttcaactcagacacgtacttgttgctttcatccatatatatctcattgcatgcatgctggctgcaacctatacatgaggtgtcagtggaggaaatgttattcttcacaacgaaaatgccacatatatgtcattcattttaatatattttgaggaataatatccaatgttttgcataaacttaaaattttcttattttgatttgacttgtgtataaactttaccccactaattgtggatcatattgccacagtggatgattaattaaagaacaaaatggatcgcactaatttggttgatttttgggctgtaatttattcaagttctcaggatcgttatctcgaagaacgaaatgcttgacattaatatcaatatgttcatgcattaggcgaatccctgtgttctcttctcaaagcttgaggtggtaaactactgtttttaatgcctggctatgtgctcgtggatagtcttactttttttttataagcaaaatttgattattgaaaatacttaaattgtacgcaagttgtgcccagtgcccaattaatttaagactttacattacatcaaattctcctattccaacaataagtagtcctaaagttgtgctctgtcttttccatcttttcaattttatttgcatgttagtttaatttattttaaaataatattttttttgtcaatttcatgagagtcttaaaaaaaattcttgaaaattattcattttcagacatgttagtttagactgtttttcctaaagtggcgtatatatgttgttttccaaatcttagctcgatcatctatagctgaatagtacgaaagtcccaatgaaaaattgcattcatacaataaatttatacatcttatacaacgctttttttttttttcgtatcacatacttatgccattttcctcctcttctcttcctgtttctctcttatttgtaaatagaagttgtataattttattttataaatataatttctcggcacaaatcacatgggtgggacagataatgggaatcatgagaatcaccttgtctttaaccacacatacctcccaggaccaaattaatctcctctaccaattaaagcagtcaagtgaagtttcaaaatctattagttttgcatatctttaaagtatagttgtgaaacttgatttggtctgattagttaattttgcatatctttaaagtatagtagtgaaacctgattcaattcgatcaattgagctggtctgatcatgatctaatattttaattggattggtttcactattgaattaattatgcaattgacttagaatgatctatccgattaggtattggatcccggttgaacagatctcattgattttataaaaaaaatcattttgaactcttattagtattaattgttattttagatttttgggtatgaatgaacttttcttactcaaataatattaattatatacttatatataatacatacatatataattttaaattttcaatatataacaagtcaaaccgaatcaattagtaactcatcgattaaactattaattcaatacctcgatcaggtcgaattcacaattattctttaaagagttcatttataaaagattcaaatctatagtttattattctttaaagagttcatttataaaggatttaaatctatagtttattgtagatcggacctttattaaggggagaaaatgtttatgtgtgaattatattaataacttgctctagctagcatgctgcaaaatcacatattctaatttcactaaattcaaccaactttatagcaagaaaatgctggatatcccgacatatataaactttggctaagccataccaaaatgacgcgttggtttttttttttttttatcaaaacaggaaaaaggttgttttttattatcagcaaaataaaacatatataaatcataggcacaaaggatacctaaaacccatactcatgaacagtatcatcaaatgaaaaataaatttatttctgtattttcttatttccatattcatttataaacttatgtctcaaaaaataaaacggctattggcatctctctgttttttttttaaaataaatcgtaattcatctcatctagttgaacacttacattactcctataatctactgtatatctcaattataaatttataataattctaacaaaagagggacatatcaacaaccacaatcttcttttgtaaaggcaacctatgccaatgggatagggaacttcttgcgcatttcccttcccgggatcttcgactattagaaaatgacactatatatatacaccacatggttgggtccattattgaagccccacttttgcatcatccccttcccggttgcatgcacttcctttatgcatgataggtgtaattatgatctatgaataatataatcctcagtttttttcacccgacaagttactaaaactaatttaattaaaattaatgatattaattacaatgacaataggtgtctcataagtctcttaattatcattatctttttttaattatgatattaatatgaagttgtcttcataaaaaaatgataaattttattagaaaaccttgagtatatacaagataaatatttttttaatataatttatttcatattcaataattaataaaaatttgaaccatagattagttaattaagaaaaatacacaattatcatttatgttaattattgttggtattattatctttttttttcttccttccttatcaaggactctctttcttagtgttctatacgtatcttcctttgtctacaactctatatctgtagttttgccaattacaaaacagagagtcgtgtttaagcatttgaaatattaaaataaaatgtttcaaagaatagtatattattataatttcgttttgacttatgaataatgcttcaaaacagagagttgtgtttattattattattctttctatttggaaatatctactaatggatcagaatagaatagatgtccttcggctttccggataagagaagctttattttgaacctagaactgtctagatgaaaaagttgatgatgtatcaagtttcttgagagatttacttaattttaacaatatttctatgaaaattatgtcaaaagctaacttttaattaagctatatatatatatatatatatatatatatatatatatatatatatatatatatatatatattcaccaaaaaaatatacatatcatttataatatttcgttttttattcattactaactaaaaataatttctactgttagtctgttacacaaatatcgagatatttcatttcattttcaaaaattaaattaaagtaaatcattttaataatttattccgacatctaaattaaaatacactcatttatctgtcatgatttctgtcgcaatatttaatacgtaccggaaactcctgccaaaacttgaattggaataaaataatttccataaagaagaaagtgacaaatatccattccaattcctgtatgatgttttttttttttttttgcaataaggaaatttttaatattcaatcccaaaattatgaggtactgtaattttattttattcttttcaggtttatggtaatctatgtatttttttcattccttttatataactgtataaatttagttttaccatatagctgtttaattcaacatatccatgtattatgcgtgtaagttttttagtaactatctttcaaatgtttactactattaaaattgctattttatactaaaaaaagctgtttatttatcaccgccataaatttaaatgtattcactagatcagtagatatgtttgtaaaatttaagaaattcacgcctagctatatatatgtaacaattttttttttttataaagaatctatgcataagtcactacggaaaaagacatatttaactgatagttttctttaatgacaattttaaattatctttgaagttaatgtcgtcaaaatttaagaatttctacaatgatttttaaaaaaattattttagaaaaatataattttaaaatgatttttaaataaataactatcttaagataattttaacttaaaaattgtcttaaaaaagaatcattagaatatatttatttaaaatatatttaaaaaattgagaattttaaaataatttttatttgaaaatcattttaggatgttttttttaatgaaattttttgaaaaataaccgtcttaaaatatacatttttttaaaatatataaatactaagattattttttcaaaaatcatcataaaaatctactttgtaagaaagttgttcgagtcttaaaatgtcttttaaaaaaaaaatagactaagatgacccagccaaaccacaagccatcatcttctgactctaaaaaaaaaaaaaaatactaagttagcttccctgaaacaaaagatttaagaaaggaagaaaacaatgtgtttttttggttatcattacctcaactttgtcattgttgcatatgggaacggtaaggagttgttgtttcttccttgtttcattgagtgaggtgtgactcgaccggcgagtcaactcggtgaagaagtcttcatcgtcgctactcttagtcccggttgaaccggaatgaactagttaagttcctatcgagtcgaactcgtaggaaaactcagacgagaacccgaacgcaacgtccaactcagtgtcatccatggctcactgggtgaacaaaagattctaacttgaacttgaaaggaaaactgacatgaaaatataaattatgggaggtgagccatggcttttgtggcttcaggtaataggcatcgtccatgggttgggccttgtgccctcggaaataagcgggtcatggcgatctggatggcagagttaactttgttagaggaggcggagacagaggaaagagatgtttaaatcactctttgtctttgtttctctctctctcccgttgaagacctagatgacattcgacagaggagagagggagaaggagaacatgaagaagacaacgagccagaggagaggaacgagcgccaacatttcaaagttaaaattatccacatttaaagtcgatttcgcgagaatcatatttgaaatgttggtaataattacaaaattattaccgcgtttaaaatgatgatgatttttggaccatcgttgttaaacacatgtcttaaaatcatgtatttttagcagtgagttgcgccaaagtatatcacgtaacttgctcagtcttttgaaaacaatctatttgtctgcaacctaagtagaaaccagctattgtaattaaaagtttaacgctgcatgatttgagttctgttttgtcggcggggactagggacaaatatattttttgttagttaatttgtatatttattggtgatatgtctgaagttaagttaattggccatgcatgtgtgtgtgtgtggtagtgagaagaattgagaaaaagaatgtggtctccaaagtccaaccaatacaaatctctagctctccctccctctctcttgtatccctttatatgaatcttctcagacacgttttcgagagcccctttttccttatcatagcctcgcagcagctgatatctcatgttgttcttgttcctaacaaagtagcattaaaaaccatggcatcttcaccggacaccagcaaaaccataaagctgatgcgttacaacagctacctccgcagactcaacagcttcaaactccttaagacatccttcatcctcctcctcctcctctacaccctctccacccaccacctcctcctctcctccgccttccacggccccgcatgggagaatcaggtccgccactccgccctcccccgccgcccccacggcatgtcggtgctggtcaccggcgcggcgggcttcgttggctcccactgctccctctccctgaagaagcgcggcgacggcgtcctcgggctcgacaacttcaactcctactacgacccctccctaaaacgcgcacgccagcacctcctcgccaaacaccaaatcctcatcatcgaagccgacctaaacgacgccccgttgctcgccaagatcttcgacgtcgtttcgttctcccacgtcctccacctcgcagcacaagcgggcgtccgctacgccatgcagaacccccactcctacgtggcatccaacatcgccggattcgtaactcttctagaagcttccaaaaacgctaacccccagcccgccatcgtttgggcctcctcgagttccgtctatgggctcaatgacgaaagcccattctccgaactccaccgtacggaccagcctgcgagcctctacgcggcaactaaaaaagcaggcgaagcaatcgcgcacacctataatcatatctatggactctccctcaccggattgcgcttcttcactgtttatgggccctggggaaggcccgacatggcttactttttcttcactaagtccattctccagagaaagcccattgacgtgtaccagacgcatgacgagagagaagtcgcgcgtgacttcacttacatcgacgacgtcgtcaagggctgcctcggtgccctcgacacggcggagaagagcaccggcggcgtcgtagggaagaagcgcggccccgcgcagctgagagtttacaatctcggtaacacatcgccggtgccggtgggtaaacttgtttccgtgttggagacgttgctcggggtaaaggcgaagaagcacgtgatcaaaatgcctcgaaacggcgacgttccgttcacgcatgctaacgtgagcttggcgtggagggacttggggtacaagcccaccacggatctcgccgctggtctcagaaagttcgtgcagtggtacgtcgggtattatggtgttcgcttaggggtagaaaaggaaaaacacgcagacttggcttgattcatcctttccgtgcccctccattcatttattataattatatgtttttttgttgaaacttgtgaatggtgctggcggcccatgtgagaatgcataatcatgatttggtattttaataaaatgctagttgcatccagtattattatctgtgcacccaacacttaagatgaaatgacaaaaatatctttgatccgtaaatcatttaagttgatctataagagtcttatggatcaacttaatccgtattgtttcgtaaaaggtttacggatcatattgatccgtatcaaccttacggatcaacttgatttgtacgatttacggactatcctcacacacattcatcacaaatgcggaaaaagtgtagagataattttggtatttttataaacttgtgaatttcaacaagtctgcgtggtgtggcaccattcacaagtttcaacaagttttattaaacttgtgaatataaacgtggtatataggtccaaggtaataaaagcaaggacaagagcaagtgtatatatgtaatctatgtgtgaggtggtggagggggagctgagctgtattaatgatgggtgggctctactttaagcttttccaacttattattgtattttcaaaattaagttaaattgtgtatagacaataattatatgacatagacatgcaattttcttacaattatattactgcctcacttctaagacaatgatattttaaacctgtgacccactaattcacaaacatttaattgatataaattttaaataaaatattctcaatttattaactcattttgttataagctaattatcccattagccatcaataacaataaattttactattcatcgactattttttttatgataaatgtctcttttaattgcatgtgttaattgatctttttaattatgcttaagaatagtatttaaaaaatagtttaaaaagctaaaaagattattgttttgaaaaaaaatagaaagaccatttgttttaggaaggagggagtattatatgcaatagtctgtttatcattaaatgaatattaatttttgttacaattttttataagtcgtgttttttttactattttttaaatgaaaaatgaataatttaatacattctcaactttttttatatttagtttagtgtagtgaaattaagcacaatttcaccttttttttaaattgtttaaaattcacgactccgcattatattataatatattgtgttaatattattagtaaataattttttctcatttactatttggttgagagaataaggttatattattagcaaatgcattatttgacaaattttaattaagttcctaaattattttttttcaattgttctcttaacttatatttttttaaatgatgttcctaaactattaggaataaatgtatatgtccaagaatcaatctgtcatgtaactaattaggaataaatattattagaatttgatcatcatgtactactataaaacaattgattggataatatctttaattaaaatcatggactcattatcataaactagtattgtataaatttaatccaaattaatcttgattataaaaaacaagagacatccaaattcaaaaaataatagcatttattaaataaagattaataaatttcatttattaaattacacatatagatgatatatatgtgaatataattctaaaagttaataacattactttaaattatcaataaaaaattcataagaaaaaaaaaataattttgttttacttaaaattatcataataattaataagttctttattatattttaattttggacatcttctatctattttttaaacaagatacccaatatcttaaggtattagttgaatagttattaagtaatgactaatgagtctgagttttatttaaaacaattattttttcgaattatttttctgggcgataaatgaacttaaactaatcatttacgcacaatattaaaacaagtaaatctctcgtgacatttctttttgatacacttgaaactgatcaaaactaatttcttaccagggatatgagtccctttcattcacatcaacacacataacagtaagtaattatttttccaaaaactctaaccagaaataaaaaagtaattccaaaattaggagaagcaattgtaaagaagtatggactatggagaacaaaaaaaaaatttgctgattattgggggaaaagaatgggttggtgtgttgggagagtcaacagtctacttagacatgcggtacatacaccatatatttgaaagaaaaaaaagcgtagtcagaggaagcatgcgcgcatctacctacccacccttttcaattatgcatgtatatatatatctgagccactttgccacattcattcccaccctcatacccttttctttcgtgcctagctactccttaattactttcattctttaatttgctgcaagctatagcttcattagttcattcacaaaattaattattacaatggtgagtgttgaagagatccgtcaggcacaacgtgcagaaggccctgccactgtcatggctattggcaccgccactcctcccaactgcgtggatcagagtacctatcctgactattatttccgcatcaccaacagcgagcacatgaccgagctcaaagaaaaattcaaacgcatgtgtaagatatctctctcttttatcctatcttcatttcattatataatatgcatgttgcttatttccaacatatacctttgatttcattaatgatatcaatgaaatttaatttattatttcaggtgataagtcgatgattaagaagcgatacatgtacttaaacgaagagatcctgaaggagaatcccagtgtttgtgcatatatggcaccttcgttggatgcaaggcaagacatggtggttatggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgtccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacattccgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaagttggtctcactttccatctcctcaaggatgttcctggactcatctccaagaatattgagaaggccttggttgaagccttccaacccttgggaatctccgattacaattctatcttctggattgcacaccctggtggacccgcaattttggaccaagtggaggctaagttaggcttgaagcctgaaaaaatggaagctactaggcatgtgctcagcgagtatggtaacatgtcaagtgcatgtgtgctattcatcttggatcaaatgcggaagaaatcaatagaaaatggacttggcacaaccggcgaaggccttgactggggtgtgctatttggtttcggtcctggactcactgttgagactgttgtactccgcagtgtcactgtctaatcatatatattgagcaagaacacagatccttcttttcttcttatgtattattgcttttttagtttgaaaaatgtattctttctcttttgctttctcacattcttcttttttgtataccagtaaacactaaacgagaacacatcttattattaatgcaattaagcttatacacaattgatctatactatacagttgcaaagtgaatatcttctattttatttttaccaatttcatctccaacaaaagattcttcgtgattgtgtataaattggactgtagaactgtttggaattatgtggtttgtgtaaagagagttgtgccgattaacttagtccagtttagcttaaaattttctgtcttgggtgagttatttgactgtgatatacaacattatatgaaacagatcaataagtatcaagtaaaccgcagtaaaaaaaaaagtatcaagtaaacctagtagctaagaaaatgcacttcctacgtcatctccggaggactcttgctcaaaagaggtggaagtcttgctatggagatttatacggacgaaaattatgtagattcagtaagggatatgttggaaaaccaccttaattgccgtcagtcctatccttctttagttggggcctctttggggttgccttaattgaaacttcaaggatgatggtttagtcccacatcgaattaaagatgtggtttaaataaaacttggacgatcttcatttaacgtcgattttttggggttgatttagtccctaatactaagaaagtatcctaccatttttttagcctattgggccacccactattgaattgttattggaccaaccacatatttcctgttattcttgattatcagttgcctaaataggaagactcttgagtcatgattgtattgcaaagtaagcaatgatacatttttctacaattaattatcttcaataatatgatagtattgtttttatcatattatatatagtttgtatttgtaaacatattataatttatgactaaaacaggtcggtgataaggaacatttttatcagaaaataactactaattctaacattggagcctatactatacctggtaggtgatatggatatccccccataaacgtgttaatacctacacacacgtgttatatgtggtgaaatagttaactgatgtaaaatcaataatccgaaatgatgaccatactttttgtcccaactgagatttaattctttaagtaatcaagatagaagtgcattttcttagctactaggtttactagatatttatagtttgtcagattttaagggtgtgataagaattacaacttggttgtgacaggttatgctaatgacaaataaatgctaatgagatatcaaaattatgcttttatgtgcaaggttttaaatggtcattcggttttaaaatgctcattacataagtaaattggttggtattaatacatcacaaaactccatgactgaaacaaactaacaaatgtccctaaattgtgacagatttcacaataaaccaaggcccctaaaacagaatcaaattggtacagacgtaaaaaaaaattgacacaccataaccagaaacaaactaacataccatgattagaatcatattggtatacaatggccagagcagcagagccaaattggcaccccatgagattgtgataaatttcacagcacaccatcacccgaacaacaaaacctaaatgatacacagatagaaccaaatcataaattacaataagataaaaactgaaacaaattgtgtcacaaattttacatattgaatcagaagcacaccataaactacaatctgataaaaactgcaatctgatactcaaccagaagcacaagataaactggaatatgataaaaactacctaaagtgataaactgcgttatgatatttcatatattaaatcaaaagcacacaatgaaaatgtaatacaaactgaaacaaattgagtaatagatttcacatattgatgcacaccataagctgcagcatgataccaactgaaacataaattctaaccttagagcccatactacacctcataggtggtatggaacatttattttaaagtgttaatacgaagtcatggataaatgttatctattgtggttaagtagttaactcttgtaaggcaaataatgcgaagagcagtccaaccactttgtcgacttagattttgttcattaagtaatcaaggtaggaagtgcaatttcttacctactaggtttacttgatacttattaatcccttttttataatgtttttctcacagactcacagttagataactcaatcaacacaaaaaaaaaaaaaaaaaaattaagcctaagtggactacgttaattggcactattctctttacacaattaagccataaacctgcaaagttctacagtcacttttatagcaagtcacaaagaatctttcaataaagatgaaattggacaagagatattcactttgcaactgaatatatagatgaattttgtgaaaacttaattgcattaatagtaatataacatgttcttatttactgatataaaaaaagaagcatgtgagggaagcagggaaaaaaaggaagagaaagaatacatttttcaaactcaacatgaaagaatgaataagaaagaaaaggacttggtcttgcacaagatatatggattagacagtgacactgcggagcacaacagtctcaacggtgagtccagggccgaaaccaaatagcacaccccagtcaaggccttcaccggttgtgccaagtccattttctattgatttcttcctcatttgatccaagatgaatagcacacatgcacttgacatgttaccatactcgctgagcacatgtctagtagcttccattttttcaggcttcaagcctaacttagcctcaacttggtccaaaattgcgggtccaccagggtgtgcaatccagaagatagaattgtaatcggagattcccaagggttggaaggcttcaaccaaggccttctcaatattcttggagatgagtccaggaacatccttgaggagatggaaagtgagaccaacttcgcgaaggtgtccatcaatagccccttcactgtctggaaggattgtctgggcagtccagacaagctgaaacaaaggcttttcaactggtaaggggtctgatccaacaatgacagcggctgcaccatctccaaacaaggcttgacccacaaggctatcaagatgggtgtcagttgggccgcggaatgtgactgcggtgatctcagaacaaacgacaagcacgcgagcacccttgttgttttcagcgaggtctttggccaaacgaagcaccgtgccaccggcaaagcagccttgttggtacatcatgtaacgcttgacggaggggcgaaggcctaatagtttagtgagctgataatcagcaccaggcatgtcgacaccactagtggtgcaaaagatgagatgggtaatcttggacttgggttgaccccattccttgattgccttagttgcagcctcttttcccaactttggtacctccacaaccaccatgtcttgccttgcatccaacgaaggtgccatgtaagcacaaacactcggattctctttcaggatttcttcatttaagtacatgtatcgcttcttaatcattgacttatcacctgatcgaaataataaattaaatttcattaatatcactaatcaaatcaaaggaatatgttgaaaataagcaatatacatattgtataaagaaatgaagaaaggagagagatatatatcttacacatgcgcttgaatttttctttgagctcggtcatgtgctcgctgttggtgatgcggaaataatagtcaggataggtactctgatcgacacagtttggaggagttgcggtgccaatagccatgacagtggcagggccctctgcacgttgtgcattacggatctcttcaacactgaccatcctagctagttaattttctgaagcaaagaatgaaagtgtagtagctaggaaagaaaaggcttggatggatgttgcaaagtggtttggaagggtgggtatatatatatgaatagatagacagttgaacttgaagtgggtaggtgagtactgagtagatgatgagcatgtttcctctaacgaattggctgtgttctgtgttttctctcaactatattgtacactgcatgactatgttgactgttgactatcccattataatgattatatatataccttacaaatttgattaaaaacacgttaaaatgattctcaaataaatagatttggataaaaggacatagtcatttgttgacagagaaaggatatagtcattgacattataaaaagggagtgtatcgtatcaacatcatcaacaaagtagctttaatgttaatagtatttagtaattcaatttgatttggattgattcagttatttctggcaaaactaaaatcgactccaatccaatgaacaattttttttttcttgagatgcaaaggatagaaatattattaaaagcagcttagctgcacaagttgtgcccctactgaaagttatatcagaatacaattttgctgtgcatcaaagctatctaccagcaacatgttgcataattacgaaaaaaatagctttatcttgctgaacttggcagagcctctaaacatttacgaataattcagccatccgattatagaacataaccacgagaaaataaaagcaaccacctatcgctatcagcaaaccaaatgaagcaccagttgaacgccttgtattcccaccaccgaataccaaaattgaataaatttgattttgagaagaaaaaaattgcttattattattgttgatgtgaaatccacagaacctgtcacacataaacccattccaaacactgatgcttcccaaattgcattcgatgaaaatgctgacccaatcatccttaaagtttcccaaaggttttctcgatctcactaaattaaattcaacaggaattaggttgggttttaatttttatatctgtctttattaatcggataagtgaacaaattcgtaaaagtaaaagcgtaagacgctgttaatttagtcttgaaagtgctaaaatgaccaaaggtaactcattttaatccaaagtttcaaaggtcatgcgatgtaaatgacaataataacatactttcgaaattaaaatataatatagttaaattaaatttaaatactaaaataacaacataggaaattttaggaacattttttgttttcttgagaaaataaactttgttgttatttcattttaaatacaaacctaattatttaacaagagaatctatgtttgattttccaccgtatgtagttacacataggcttaattgcactttttatttttaattttttaatttttagtgaattttatccctaattttttaatttgacacattttattttcaatttttaagaaacttgtgaattttatcctctattatttatctatttataagcacaaaagttggggtaaaatttgtcaaaaaaaattaaaattaaggataaattttgtcaaaaaaatttaaagttggaataaaatttggcaaaaactaataagttagggataaaaaaaatataattatgtaactagtaaagtgatgaaggataaaatttgtaggattattaaaagttgagataaaatgtccaaaatttaaagattaagataaaattcgtcaaaaattaaaaaattagaataaaaaatataattaaatctaatgtttagtttatctataagaaaaatttcaaacctgaccccatcttattgcaatgcataatggagtgggtcagtccttccataggatcaccctggaggccacccccctttttttttccctctatgaccttcaccattgacttttcctaatcatcaattcatcactttcgtggcttctcctaatgaaaacgtgttgattaaaaaataaacaaaaaaccaaaaatattgggttgttaaaataagagagtagtcatcagtctacgtagccatgcggggcaccacatagttgaaacaaagcgcagccacgagtcagaggaagcatgcatagcatctacgtaccttagcctacctaccaatatcaactatctatatatatccacctttccaaatcactttccaacatccacccccatcatcatatcataccctttctatcctacttgctacttcccacttccattcttttcttaaccagctaggatggtgagtgttgaagagattcgtaaggcgcaacgtgcagaaggccctgccactgtcatggctattggcaccgccactcctcccaactgcgtggatcagagtacctatcctgactattatttccgcatcaccaacagcgagcacatgaccgagctcaaagaaaaattcaagcgcatgtgtaagatatatatctctctcctttcttcatttctttatacaatatgtatattgtttattttcaacatattcctttgatttgattagtgatattaatgaaatttaatttattatttcgatcaggtgataagtcgatgattaagaagcgatacatgtacttaaacgaagagatcctgaaagagaatccgagtgtttgtgcttacatggcaccttcgttggatgcaaggcaagacatggtggttgtggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgcccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacatttcgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaagttggtctcactttccatctcctcaaggatgttcctggactcatctccaagaatattgagaaggccttggttgaagccttccaacccttgggaatctccgattacaattctatcttctggattgcacaccctggtggacccgcaattttggaccaagttgaggctaagttaggcctgaagcctgaaaaaatggaagctactagacatgtgctcagcgagtatggtaacatgtcaagtgcatgcgtgctattcatcttggatcaaatgaggaagaaatcaatagaaaatggacttggcacaaccggtgaaggtcttgactggggtgtgctatttggtttcggccctggactcaccgttgagactgttgtgctccgcagtgtcactctctgatcatatatattgagcaagagaacaaatctttcttttttcatatgtattcttggctggccggtttgaaaaaacgtattgtgtttcgattttttttcccctgccctgcaaatgcttctgtttgtatactagtaaataacaacttgttatactattttttcaattaagcttacacacaagttatctatatatgaagttgcaaagtgaatatcttttgtccaattttatcttcattgaaagattctctatgattgatgataaattgaactatagaactgtctcgaaccaggtttacttatgggctaattgtgtaaagagtgttgtgtatgagttatctgggtgtgtgagaaaaattatacagaagaattcaattagtatcaagtaatcgtggtagctaataaaatatacgtcctaccttgattacttaaagaacgaaatcttagttgacacaaaagtatggacagcgttagaaaaaaaatataaaaaatattccatatcacttaccagagtacaggcttcaaggttagaatttggatgatgaatggtttaagaaaagattataagcttccagtttttcagaagaatggggaaaccaacctcgacgatattgaagctgtctttaaagattctgaagtatgttgaagataattagacatgatattgatattgattttctgtgagttctggaatattatctcataaaggattttgcatgtgttttcaggagcaccatgtgacggagaagaacgaacagcagtcaacagcaatgaatgcatttgagttaatttctatgtccaaagggctgaaccttgaaaacttgtttgatacagagcaggtatcaagctgatatcattgaattggggaggaaaataacaaatgacagggacttgtttcatttagtgaactaaatgaaaaagtcaatttgatgaaaaaggtaaacaagttttattaagtggagttgtttctccttaccccctctaccaaacacaccattaaataaagtttcttcatctaatatcttttgtccaacttcatcttcgtagaaagattctttgtgattgaatataaatttaactatgtaaaccaggtttatttatggattaattgtgtaaaagagttgtgccgattaacttagcccactttggcttaaaattttctgtttgttgtgagttatctgagtcagaaaaaatattatacaaaagggatcataagtatcaattaaacctagttaattgataagaaaacacgcttccttcccttattgcttaaagaactaaatctcagttgacagaaataaggacaaaattattaaaaaagcaaatgttcatatcactgaccagagtataggctccagggttagaattggtggtgttattttatgagatgtatgaatcggtccttgactaattaaaataatcggttatattagcctttagagttattttctgaagtgaaaagtaagattattagttgctattaatttaattaaaaataaattctgattctattagtgcatgagatacaccattatttggcaataattttaaactcggcctgttgtagtggaaaattctgtagaggttagaaatggaattgattatattttattgtacagaagttaatgttttctgcattaataaaatagaaagtttctgatttctattgattcatagggttattttaaatttgcaatgttgtttccaaatgccactaagacacaggatttagaaggtttttaggatcagtgtagtaaggagtggtttcagtagtaggctagtagcaggaccaattttgtagaattcccttctgaaagagactgattgcagtagtatgaatattcaaactaagctccatttattcagctgaagttgacaagaagcaatctttaatttttgtagtatcttaattaaaaaatcagaaaaagatttctaaggaacttaagaacttctactagatatttatatttaagtataggatccgatgtcaaaagttacttcttcccttagtttgttttttatcaaaaggttaaaattcagttcatgtaccaaatacttcttcatccacccagctgtaattctcctgcaaaccggtaggaatggaaatatcatctctaatttcttggccttccctataggttcaaattcacctacgtgggccaaatccagaaaagaaattaaagggagaaggttaagaaaatagttagaaaatgttgaagaaccaagaaagtgtagtacctcagttaccatatttattctaacttttccaatgataaaaaagttaaatttatttgtactttgtaagtgtgtgccagaagaagtgtcatggccaaattaatttaggccatcactgtatcatgcaggtgatcttagttgttgaaggtccttgataggttatatttacaatctcgcataggtagttctatttttttaccttgtcaactataaaagaggagtatatttttttatccatagaaatcaaagacgatatcaagaaatttataactttcacccaccctattcaactaactgaactaaattcctctaatagaggaggagtatatgcatggtagctacaaaagccgtgaaagaagatttatggcttgaaggtcttgtttgtgatcttggtgcaagtccaaaggacatgatgatgttttgagatagtcaaagcacattcatttatttttatcagtgtaaggaggtttacaataactcgcacacctttgctcaaccaagtgaactagatctcttgacaagcacaattcatttaaccaagccagatgtattactggaggaaaaataaacattgatatcaggttacatttcacttgtgatgtcatagcagaaggtgaactgttaataaagaagataactacgtcttataatcttgtagactaattataaaagctcttccatcatcaaaatttaaacattatttggacttacgtgaaatgaatactaaagtcatcactttgattttatttatgcatcgagagctaacttttttaaatgaaaaaaaaattatatatttattattaatttaatttaaagtatattatacgttcaagagctaaatacatattcatcgacttattttaaaattgaagacttaattactttttgtcttgctacttatttatttaatttaattttttggtacaattactaataaagattcaatttgatttcttaattttaaaagcaatgaattttgattccttaattttcacaaaaggtgtcgttattatttaaaattaacgatggattaaaactgtcagctaatcataatcctcaaaaccgtgttcaatgacctgaagttaatctgaaagaaaggaaccaaattccatcattttataaaaattaaggaagcaaattgtattttttattaacagtggaacgaaattacacaaattaaataaatagtaatagtaaaaaaataattaaaccaaatttaaatcaattaaactctctccccctttctccaacaaacttgagcggctagtcttttttgtctcctttttcttcctttgttttgttcccacttgaaaattgcagcccacaaaaaaaataaaactaacccttcaaattaaacacaatacacaaaaatcccccgtagcattttttttcatatacataaaagctaacatgtaactcaaaagtacaagttttaaaagtcatcatatttaaagtcatcttattcaaccattatatatacatgtgaatcaactgaaacgtgattcttttaacttttaggatagagaataattttggtctagacatagaaaagagagacatcttcttcagatcaacacatgctaattagtaaacaattatttttaaaaacactaaaaaaaaaaggtatctttctctccaattttccattaggagaaccaaagactcaaagtgctctcttacaattactagaaaattctagtaaccggagaagatcctaaaattatgagtaacaattgttgagggaaagggggagaaacaataattttttagactagatcacaaatatttttttacaataagaaattctattcaaaatgaataagattattatgattagtaaaactcttactctaagtatttaacatagttacaggattcgttcgaaacttctccttaaactacaacaatctcacatcatttaatccacttgtttggtgctaagaaagtgtaatttgtggactcgttagaaaaataaataaataaataaatagtaaataaaagggtaggtataactacaactataagggaaaagtcaaaacagtctacttagttatgcggtacaccacatgtttgaaagaaaagcgcagtcagaggaagcatgcacgcgtctaccttaacggggaacctacccacccttttcagttatgtatatatatccaacattccaagacactttccacatccatttcccatcatcatacacttttctttcgtagctagctactccttaattactaattagtttcattctttggtgcaagctagcttcattagttgattcataaaattataacaatggtgagtgttgaagcaatccgtaaggcacaacgtgcagaaggccctgccaccgtcatggccatcggcactgccactcctccaaactgcgtcgatcagagtacttatcctgactattatttccgcatcaccaacagtgagcacatgactgagctcaaagaaaagttcaagcgcatgtgtaagatttatatctctctcttttatcctatcttcatttcagtatactatataatatgtatattgtttattttcaacatacaccatttatttgattaataatacatactaatgatatttaacttttttatttcgatcaggtgataagtcgatgattaagaagctatacatgtacttaaacgaagagatcctgaaggagaatcccagtgtttgtgcatatatggcaccttcgttggatgcaaggcaagacatggtggttgtggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgtccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacattccgcggcccaactgacacccatcttgatagccttgtgggtcaagccttgtttggagatggtgcagccgctgtcattgttggatcagaccccttaccagttgaaaagcctttgtttcagcttatctggactgcccaaacaatccttccagacagtgaaggggctattgatggccaccttcgcgaagttggactcactttccatctcctcaaggatgttcctggactcatctctaagaatattgagaaggccttggttgaagccttccaacccttgggaatctccgattacaattctatcttctggattgcacaccctggtggacccgcaattttggaccaagttgaggctaagttaggcttgaagcctgaaaaaatggaagctactagacatgtgctcagcgagtatggtaacatgtcaagtgcatgtgtgctattcatcttggatcaaatgaggaagaaatcaatagaaaatggacttggcacaaccggtgaaggccttgactggggtgtgctatttggtttcggccctggactcaccgttgagactgttgtgctccgcagtgtcactgtctaatcagtaattgagtcagtgtctaatcagtaatagtattttcttaagacagcaaatctttctcttttcttatgtattctttgctgttcagtttgaaaaatgtattctttgtcttttgaattttccccctgatttcatcaaatgcttctttttgtataccagtaaataagaacaagtcgtgttattaatgctattaagcttatacataattgatctataaagttgcaagtgaatagctttaatccaatttcatcttcagttttgtgattcagtataaattggactatagaactgtctgaaaccaggttcatggcttaattttatttttaaggaaggttcttttgatgcccagcagttgctagagaggatttatttttcaatatgttcatggattaagggattaaacactggatttagctcttcctttgttcaatggaatgccaaccctgtgacattcctaaattcactataagttagattctgttgtgggatattggtgagggattttatgtgagctttgattttgatggggttgatgatgtttttggtacagggcaggttttggtcgagttatacaaacccagatccgtcagtgaccattatgtgggtgtggggaaaatatttatgttatgtaattggcatactttagttgggggagaggatatctggtactgtgataccaggctgctgttattccctgtggtactactggtacccgggaccttgtatcatctccttgttctctttttatatatcaatcaattagcagtttccaaaaacaatggttgcttgatccttgtgcatctcatcatgtcacctatgttccaaaaattcagcaacatagcacttcatttcaagtcactgatcaggttttaattggtaatggccaaggtttacccgtaatacccaatggcgttaatttcagcaatcaagactatggtggaactccaattgtttaagaaaatcaattctttgcggactgattgagtacaagagcatcagccatttgcaaaatatcttactaatctaggagaagagtatttctcttcacaaaccccatcaaaatgcaatacactgtggtattgcatttccatattgtaggagaatcatgcttctctaacctccacttgtctaatcaatcctcttccttttttcccaaattaacaatgcgatgccaaactgctattcaaatctgctcctaactattttagttgtgcatgttatccattcatgcagctctataatgcacataaattatttttctatcttgtgaggaaaatatgttagagacatttaggccaaaactaatatgtacttagctaaaggtatcttcaaccttatgcctagagactgcaaagtgcaaactctctgaatttggacctgattttctctaaaacctcacctctgtaggtccatcattggtgaaattagctttagcgtgaacaaactatgtcaatttctctctcaaccactagaagatcattggaaggtggtctaatgtattcttcagtatctgctagggaccttcatcatgggctgctattgcaacttgtttcaagtctcactcaattggtcatttgcggattttatgatgcagatggcacttcagacctagacggtcatcgttccatatgtttgggtcttacatttattttggcccaagcatggtttcttggtagtaaaacaaacagccttctgttgatcactcaaatgtagaagttgaatattgaaatcgggccaacaccacacattagaaattctatggatacagtctcttctgcatgaacttaagcttcctatgacaaccccccattgtttaccgtgacaatcttagcataatgtccttgactcataatcttgtcattcagagttaagcatatgaagttgaatctcttcttcgtcatagaaacggtgctataaaagatctgtgcccaggtcagattgtgcacattcttaccaaagctttggaaagtactcgattttgtgaatttcacaccaaacttagagtggttgatcctttttcttcaactcaacccccttgaatttgaggggacaatgttagagtaaagaactttctagtgctatattagatatctgaaaactgtcaattactatgttatgtcagctcagattcaattagtatatgatcttgctatagaaatacataactatatcatagtataatgaaaaggagtaacaaattatcttacgccctagtaatttcgattattttctaagtttctatttcactcttgaatcaattacatttgacctagccagaaaataaattctaaaattgaccttatccttttttaaagctcttaatatacatgtacactcacttaaatgaatatttcaattttttttttcctttactcatgaatcaggacaacattgaagtatgtgaagaccataataggaccatggatttcaaggatcatgatctcatattaatgaagactaactttagagtattagctattcacaatttcacataaaaatcatctgctcatagaaattgttaaagggaaaatcaaaagaaaagattacaagaaactaaattgtggcattattctctaatatagtctgaaatgcttcttgtaatcttccgcgcttcatattttctgttttgccttttctgacattacaagcttattagaaccagccaataccactcattcactgaccttcttctccttgaaataccatagcttaatcttcattggattttgaaaactgtctgcttagcttgggaacataggtgaaatatcattgttgtccaggcctgagttaaaaaaaaaaagcatggctgttaagtccctgagtgactattatcatgttgtggagtacttgtaaaaacaggaagctctacgggtctatttgcaatatctttggttttgtgaagaaaggtcccggataaaattgtgacaaagccacaaacctcagtagcaatttgagatgcatcttctgtgtcccattcctgtttcagataaataaagcagataatgacttgcaatccattcgcaaactaccgacgaagatatatagtgttatttaagactcataataatttttaaaagaacttcaatttttcttagattccaatgtatactattctaaaaatgattgtgtctgagataaaaccttgatcaacccaaaatctagaaatgttaccattctagttggaatttacaaataagagcaataaggagaaacagtaatcttttatctgatatacctaaattgggttttgtccttatgctatatatcattttggcattttcagattaaatatagttcttccaaaatttgtggatttgtattgtgactatcgaaggcattatgacatacaagtacatactgtgtgaattaaatgtgattttgctttttcataaaaaaaaagttccttaaaataataaaatagagctataactaataaactaaataaactttatatgttagttgtagaaaattacctggttctgtagcaagttgccacacttccttaacagagtgaataactctttcatggggagcatgcaacacaataattgtagatcccaccatacaaagagcacatccaagcacaccaaatatgtgcaacctctcttttatgataaagtgggctagtattgcactgcatcatgatattagttgtagctttctaaaatgcacgcaacatccaacataaaaatttgatggatgaagacgtacatccacatttgagtcaaacaatgcagaaacatcctaataattaatgttatgaaattggctatttccccaacaatcaccacataaatttaagcatacatatagaattagttaataaaattttcataagattggcatattatataaatatgtattaattgaaaatatattattcagaaaataattattacaaattttaatacctagataaatgcttgcatgtaaattaattttttttcttaatttatcattattgtttaaaaaatagtctataagcatattaaaaaaaacaaatacctgctgataacatatatatatatatatatatatatatatatatatatatatatatataatgataaatatatacagtttatctcttgattttttatcaacacgttaatttaagtatattagtatgaattattttaaattttggctacatatataaaactatgcttcttttcaattattattattgctttacataaaacatatttaaaagtaattaaatgaaataaatcaaatagaattgaaatcaattagtgatgtaatatataattttattaatgcattatacataaaacatagtactttatagtaatcaaatttaaaatacaataaaagttatgaatacattatacatgtaaatttattatcaaaatttctataaatttattatacccgagttgatgggtttttaaaaattatttacatgattgaaatacctttgacatctcatgtattaaaaattttgtttaaacttgatgttattttcatttcaataattattttaatatatatatatatatatatatatatatatatatatatatatatatatatatatatatatatatatatatatatatatataaatcgttgaaataatatcatattattagttaattgataattaaaattatagaataaaaattttgatacatcaaagactttaaaaaacaaaaataaaaatcaggtgtatatatcatgaatccaaaaattatttaagccatatattatttattcaatattttcccacttataaaaaaaaaattataacaagtaaagcatgttccttatatatcagagcctgtccctgactgattcttgattctcctcatcagagccaaagcccaactctccaatacaacaacgaacaggtacactacgccttctcccatttttatttttttcctctcttttcccaatctaccctccatcttccgtcaacccccctaacaatcatttcaacgccttttctctctaatcttgcaaatcttggaaattattattattgaattgggtccttcccgcactaatttatcgaaaatctcccttcccagaaattaggttttagtatttctttctttctttatttatcagcgattcgtggcaatttttcgaaggtagggtttgatgggtgatcgcggttcgggcgctgcgaagccgatttggatgaagcaggcggaggaggcgaagctgaagagcgaggcggagaaggacgcggcggcgaaggcggcgttcgaggccaccttcaaggctttggagaacaaacatgacaagggaggaggaggaggaggaggagggagcgttgctgaatccgacagcgactccgaggaggaggagtacgaggacctggcccacaagcccattggccccgtggacccctccaagtgcaccgccgccgggaccgggatcgccggcggaaccgcgtgcgctccgtcctcctttgtggtggtggccaaggacgccgatgagaggaaggtttccggtggtggcgcgcaaatcaaggttagggtgacgcccgggttgggtgttggagggactgagcaagaagggatggtgaaggatatgggggatggaacttatactgtgacttatgtggtgccaaagagagggaattatatggttagtgttgagtgtaatgggaggcctatcatggggagtccctttcctgtgtttttcagtgcagcaggtactacatcatgaccaaaccctatgctttacagtttttgcttgaatgtaatatatgtattgcctcaatgtggttttgagttgttcttggtttggttagttagcagtttcactttgttgccttttatatgtgtaataataagctggttttactaggatgtaattatgggtagtaataaaacaaacaataacgaaagccttatctcaccaggtgaggttggctacatggatcaaggacaccctggttacctgttgtgacggatctgtgtttagtatatctaatatcaacgagtgttgtgttggctgccgaaggtttaacacgaccctcttccattacattggcttgagattggctatgcataggcggagttgtggtgggtagtgacaaaaaaataaaaagagagagaaatattgaagttgaatggattcaatggaaaaatccctcaatttgttgctgagattctcttttcactgttgaatttgtgatatgctgtgtacaatgctgcatttttttccttacacagaaattgttgataaccttgttgctgtgtatatgcatgtcttttggtttgtaatgatctttgtggaggtcaactttcaatgctttgatttgttttgtaggtaatagtactggagggctgttgggtttagctcctgcatcttcatttccaaatcttgttaatcaaactatgcccaacatgccgaattactctgggtcagtttcaggggcattccctggattgttgggaatgattccaggggttgttgctggagcttctggcggtgctattttgcctggaattggggcctcacttggggaagtttgtcgtgattaccttaatgggcgttgtgcgaaagttgattgtaagttgaatcacccacctcataatttgttaatgactgccttggctgcaacaacctcaatgggaacacttagccaagctcctatggcaccttctgctgctgcaatggctgcagctcaggcaatagttgctgctcaagcccttcaagcacatgcagctcaggtgcaagctcagtctgcaaaagattccactggtatgctgttatgttaattttgtttttgttttagtggtacattttttatttcacaattctaatatgatgaaagctctctctccttaattttgcactatgtttgattgtgatattcttttttgttgctgtgttgtactgtttcctggttttttcttctaattgtatttgctaccacaataggttcacctgaaaaggctagtaaggatgatgcattgaagaaaacccttcaagttagcaatcttagccctcttctcactgtggaacagctaaaacaactctttggattctgtggcactgttgttgaatgtacaatcactgattcaaagcattttgcttatatagaatactcaaagcctgaagaggcaactgctgctctggcattaaacaacatagatgttggggggcgccctttaaatgttgaaatggcaaaatcacttccaccgaaaccatctgttgcgaattcttcacttgcttcatcatctcttcctctgatgatgcagcaagctgttgcgatgcaacagatgcaattccagcaagcactgcttatgcaacaatctatgactgcacagcaggctgctaaccgggctgcaaccatgaaatctgccacggagttagcagcagcccgagctgcagaaataagtaagaaattgaatcctgatggagttggaactgaagagaaagagacaaagcagaagtccaggtttgattactgttgttaattgtttagaggataatatatactttttgtcctgattttatttcaaattttattgcttcaagcactttgatttttgctctgggcagttctagtatgtcctaaataggaagtaggaggcatgaactcataatgtttgaattaatggtgcaaaaaatagagagaaaactgtcaagtgtttctgtatttcttattatgtttggggtaatggaagatacagtacttttacgtcgttacagaacagttgtaattagttgaaactagcagcagatgtcacacttaaccaactatcctaactggaaccaaccagctggtcctgacagacctaacagctggcagtcatctgaacaatctaagatataaagtttggcccccgtggaggcccacttcttgcgatgatttttttaaaaaaatttgtacccgttgttatcatattctgctcttctttacaaagttctctgtctaaactaaaatttaatttcctttggcagatcgccctctcctcctcatggaagatctcgatcaaagtcaagatctcctatcaattaccggagaaggaggaggtctcgctcttattcacctgctcgtcattctaaggatcaccgctctaggtcacccttgaggtcccatcattactcaagctatgacagggaaaggcggtcctttagagatattagggaacatagtgatagatacagaagacgagatttagatagatcacttgatcatcattcatctgcttcaagaaggaatagaagtaggagtgtaagcccttatacaaggaaatcatctgtttctccaaaacgtcatagagaaacttcacctcatagaggaaggaaacaatcacgtgctgattctggctctccaagtcgtcgcaggggaagtaggtcttctccaaagattgatgaaaaaaaactaagaaacagaaggcgctcaaggtcaagatcatcagatgataggcttcactctatcaaaaatgaagaaatctcgcatggaaagtctaaacacagagagagaaggcgatccaggtcattatctgtggatgagaagcctcacagaaggagccgatcatccccaagaaaagtggatgaaagtagatccaggcacaaaaaacggttgaggtcaaaatctgtggatgataggcatggttctcctgagagattggatgaaaacagaactagaagatcaaggcatagtgataaaaggcactccagatcaagatctacagaaactagggatcaaactgatgtcagagaggatgaacgtaaaaatcaaaagtcaaaacatcgtgatactaaaaggagcaggtcaaaatctgttgaagggaagcatcgttttaaagataaatcaggtgaaaatagagataagaaatcaaaacgccgtgatagaaagcgttcaaggtcaatatcattagaagataagcatgacaaaggagacacttcacctcatataaattttgatgagagaaactttgaaccgacaaagtcccctgaaggcaagaatcactccagtgataaatatggaagtagaggtgaaaaatcagagcatcaaaagaaaaccccatctaaatcaaaatcagaacaatttgatgggagtgggcccttacgaggaaattacaaggagtatgattcaaaaggaaaatcaccatctgattctggatctgctgaagttaagcatcatttgagtgatggagaaaatgctaccagtgaagaaaattctaaactctttggagatgtgtttcaggaaccaattagaactgcaaaggactcaacaatcctgaatgataacgggacactgacttcagtgaatggtaactacaagtcagaagagtcaagtgaaaatgcaggagctgatgataacccaggtatgggaagtcctgttgtcaaacattgtcgttaattatgtttagttagatgttacaaatctgagaatcctctttgctgcaggatggatatcagtggaaaaagtgggaagtggaaagtattaagcaaacttggcttggtaatgactaacttgaatatagaaaaaaagagtatgcacttgtattgtatgattattaatgcttggttactttctttgcttacaggagtggtggttctaaatgatatcaaagaatatagctgagtatagatttgttattcaatcttgaatcagaagggtgtcactcaaggctactatcatttcttgtcactatagtgtagatttatttcaagagcgttgcacagattgtggttttctgtggttgaagatttctgcacctgtcaatgattaagggataaagagcgtattctaattcaggattctcgtttaggtttcctgacaagttctttccaaggaatatactgtttcttcttaggaggaccacaattctcagaggatgatgcctccactatttgattggtctccagaatattctgttgccttatgaacattttccattgtttatttcttttgcaggtcggattggtaaagatctggtgtagaatcccacagctgttggtgtggtttaaggtttcaagaagtgtcatgcttttgtcatgatcaaccgtgcagtgcttatatcatgcttcttttactgcttgattgatgtatgttggaatgttattttaagtatactattctttttattgaaggtaatttttactatgtttgggtcttgatatttatttttaaaatttggtggtgtctgaatattattggtttctagttcttcaaaaatgatagttcggagggagaaacccttttagccagtgttcgattatatgcatctaaaacttattggactaaagatagcaataatgttaaatttaactttcagtggctatttaagtttatctcctcctcagtctttcatatctagattctatagttgatgtggccaattttgttgtataatcttgtttagttgcaagcatcattatttgatgtggccaacgataggctccattgtgtttactcatgttttgtggtatggtgggtatgttaaatccaaaacaaatgcaggttattctcattgaaatctgttggagctttgagatacagttatgctgggttgattttctcttgtgtaattgaaggtatgaagtcagattctgatgctctatggtttagagcttatttgtttttcttctagtaagttttgagagcaatatgggaggctgcttagctttgtattatgtacgaatgcatttgctctaagtactgttttccaatatttttaccatcatctggtgtcttatattgtcgtgcacttttcccccccatttttccttttgttttttttcctttttcttttttcttttcccccccaagaaattgtcatggttaggtaaagcttctatataaaggtcaactgaacctggatgttgctgctatgagtttcatcatgttgcgtttgagcaattggctgagttacagtttttacttaagtaaatgctgaaacgcaaatgatttcaacaggtaattctctgtaaacctatcgggtggttcttccatttgtgtaggatcttcaatttaattttgtcagtcttgttcatgctttacttagttctgtatgttgtcctgttcacattgatgtttttgcattctttataaatatttgcatattgagtagttttcagtgtcatcttaatggttgagttgagtttttgttgtgttgatctgatacggtgtcacaacttaaatcgtgggtttgaaaaatgagcttgttgctgagaggtgctaaagaaattctggtttttttttccgctgttgatgggtcacaactaagtttatccccttgttttgtgctctttttttccgtccccagccctgttttctctttgccccttctcctcccattgcttctttattttttggttaggttaagcattggatatgatgatcttatgagcagctgcaaattctcttcaccagatgattgtgtgaagtttgtttttggaagttctgttggtgttttagtttccttttcttcttatctcttcaccacctgatctagtcacctgatgttattatgccttctccagttggcgcttaggcttttaccataaagtgtttgttcatagttcggcacggcttaataaaagaaatgggtagtactattctaggttattgttgagctcttaacatgttgatgcgtgcccttcaacatatacaaataactagtggctaattgagcgtttgatggtttaggcccttggggaatttttttatcgaattggtcctcttttttcctcgaaaattatcctattttaagttgtacgaccgacctacttagttgtaggtaatcatcatcaaaagtgaaatcactttgttcgatgtatttcttgctgcacaaaaccaaggttttaaaattggtgaaaataatattttgaagtggaagtttattaaaagtgtgtcaaatctaatatattccaactcttaaattgaaatttgtttttcttttttcgacattctatgatttttttttattagggcacttgtgtgcattcctatctgatctggtcacgacttagaactaagaaatttaagccgtgggatacacatactagagaagtgataggtctacactttaatctttatcagttatcacactttataatacataatttcttattggttgaaatttttggaaatgataattttagagtcttacatcgattaatgatcttttcttaattaaagatagtgtttgaaaaaagtgtctcagtacttctttcataaatacacttaatttttacatttatcaagttcttgcgatgattgttaacatcaatacaattacaggtgttaatactcctttcatttcaaaatattgatcgttctagattttttttaactggagttgttctagatatttttatccaaactaagaaaatataataaatagataaaagaaaacagtaatttgataaaatcaattttattattattttacaagcaaaaaaataagtaatgttatgttaaaaaattaaaacaataattattttgaaacttatttttgttttacacgataattaatgaagagaattatatatatatataaacgtcatcattggatagaaacgatgtccttatcaaacttaacctactataccagccaagtatgaaaaacaaacaatcttggtcccgttttgtcgtcaagtttattggtgtgctaatctaagtaagcttttgtattattatttttcagtggcagcctttctaagtaatggaaacaattgatgacatgcatatgtttaagacgaatgtctgtaaaaatttgtgtttggtgtttttattttaaaatcattttagtaataaagttcagtgtaaaaattgttattcgatgtgaaagttacttaaaattggtttaacttgatcattttttatataaaattaactccttaacataatactatcgagcatgtaaatatttatctaaaattgtgttaactagtatgtcgatgtggtattggataatctagtatgaattcaaagatgaaacatatgagtataacaaaaaaaaagatgaaacttatgaagttaagttgcacatgagaagcaacactataatttatcaatttttatttgcaaattgttaaatagagtttcttaatcaagtaattttgtcatttcactcaatgataatttaatcactactttgtaacatagttgatctcaaattgaatttaaaagtttttaattttgagaattttcttttgactatgacaattaattgcaagtatttataatattattttataaacattaaattcatttaaattaaatactttctatataacttaatagttttaatcagtatttttttgttagtatttcttttatattcaatttagattaatctcatattacgctctctaaactaattttgttttaagagtaatacaatattttctcaaaattaattttctattaaaaatctcaatcattggacttcaaataaaaaaaatcaaatttatttcatattaataagttatgaataataaaaaataaattaacttgatatgtatacaaaagaatcaaaatttaaaacaattacagaattttttataagaactatcaaaatcctctctctatatagattataataacgatcgtattcgataacattttaggatcttttttcaatgagaaccatttttactgtttttcttatcaatgagagccattttaggatttttatttattaacctgttgtctctttcaatctatattttgtatttttatttttaaattattttaatattttcttattctacaatattgaatttttcattataaattgtatatttggaaatatttatttattgtaaaatttagatacatgaaatagatatttatcatttgtcttgcataagctaaaatactagaatgtgtgattttatcatccaaatactttttatgcatcattactattttatgaaatttaatttctatatccattttaaagttattatttttaattcaaaagtaaatataaattaatttttttctttgccttcttaaataaatattaaccaacaagtcttggtctaaataatattatacagattttaaaattacataatgtttttataactaccataataaaattatataatcttactaacaaattaactacaaacaatatactcaaaaggcggcggctttattagtttactttagcactacgttcaaagtaaatgtgcaaattaacaatcaaactgttcgcaatcagtgaggacataagaattcgataaagagattatccaaattatttgtttgtaacactaacgtcaagaagtatgaacacaacacaagaatacaaacaatatattgttataagttaacgttgctgaatcgctgacttgaaaatgtccgacagagaggataaaccaaaagatagagatatatagcaaactatagtatattttaataaaaagataaatatttttaaagatttcgaagtctcaaattgaaattccatatattcggaagcaccctacaaggcacaaaaaaacgtttatcaagtagttgatttttttagtctctcaaattactaattttttttagtctttaaataaaaatttatattctcaattttgaaaaatattatttttagtctttctcttcaaataaaatttttcatttttttagtctttaaattctaacataaggactaaaaaaatattgttaatatataaactattgtattgtaatttttgtaagattttttttacaatctttttataaaaaaaatattgtaaaaaaatattgcaaaaggtataatacaaaaataaaatttgaatgataaaactattcaaatgaaagaaataaacaactatttctttccttttctcatgtaaataaataaataaataagatttgttaatgagatttttaagtaaactggatgttagagattcaattacttttttttcatgttatgattgattattatagatatctaacttagtgctttgtttttcaactcataataataatggtgatttttttttttaagaaaatgatgaaggtgttttattgatatgttctttattgtttgtcaggatgcaatttgggttgttttaatttttaaaccgtgtagcagcatgctactgaatagtgatgtagattttagaagtatattaaccataaggatcatcataattataaaaaatacaagttaacttaaacatgttaataaagtggatcaaatggtacttgtcaactgttttcttttttaaaaaaatagcaggtatttgtcaacagtaagaagtatatagtctacatgtcaaaaagagtttacatataaaggattaggtataacaacttttaagaataataaaagatgtaacttatagaaatggtttttctataactattaaaaacaactttttaaatagttataaaaaagtggacttaattattattattttaaggagaactcttttttttaccaatttaaggaggacttaactgatgttaataatgtgggcaaatggtatttgtcaactgtttgaaatataatctacatgtcaaaataaaactacacgttacttatctaaatggtttctttccctcttacatagaaattagtttggttattaaggaaaaaaaaaagaaaaaattgtgaatttaaaactttcactaatacaaactaacaactaacacttgttgataaaaaaaaaaaaaaactaatcttaccttgagcccgagatagaaaaaaggtacaatcttatttgaatgttgttaatctaaaaaatggagataatataggaggaaaataataccgatgtattgtacagttgattgcacctcaatctatttgtgatttttttaagtaacttttatatctatatttttatttatatctgatattaaaattcttctattacagttattaagtgataatttctttaaattttatttattttttatatttttaattatattgaagtcgtgaaaagaattcttgcgaatacttaacaaattctgattaaaaaaataaatcttaacaagtaaaaaatgaaagtaaggatacataaggtatgacttattttaattagagaagtgttacaaaatattttaaatagatatataatttagtgtctttttttcatgtcaagggatgatattatatttttcagaaattagattctcagaaatattataactcaaaatcttatttctaagcatatttaaaaacatattgatatttttgaaagaattttaaaatttaaatagaaataaaaaaaaatggttacatgtgtgtttaaaacaatttttcgagtatccccataaaagatatcacccctttccaaggaaatgaaaacgtagggaaattatggagacatttgttttatagaataaattatattcctgaaaatgatattttttaagaatgttatccccataaaaaaatgtttgataaatacttatcattctttgtaatattttaaaatttattttcattcaaaaatgaaaatattaataaaaaaaaggtaaaataagatgatcgaactgaaagttatgtcaaaaaaaacttctatttcatgggaatataggatttcaacaccttcacatataaatagaaaaaggagaaatatataaaatacatacttttgaaaataattcacgcctaattttgttttataatttatatcaaacatgaaaatgttacatttttaaattcacatataaggaaccgattttatatgatttgaaacaaacatgtttatagtataaatagaagttataactttctcaaaaataattttcaaaacttataacaaagacgagaattgacattttgatatttacattatgagaaatcaactcgaaacggtgaaggtttttaattattatgttcaatttgggcggttttaaagcgtgtgcaatatgttagtgaatagttatgtaaatttgagaaatatatttaagtacaaggttcaataactcctaaaaagaaggataagattccataaaaactattaaaaacaaagtgagcttaaacatgttaataaagtgggccagatggtatttgtcaactgtttgaagtgtagtctacatgtagaattggtttttaagaataataaaagatgttacttgtagaactggttttttttctataattattaaaaacaacaaattttaatcactattaaaacaaacaagtgggcttaaacatgttaataaagtgggcaatggtatttgtcaattgtttgaagcagagactacatgtctaaataaaattacacgtagaagttaggtaagataacttttaagaacaataaaagatgttacttacataaatgttttgccccctacgtatagctttcacaaaagctaatcttactcgaggtagagcaagacagtcttggaatgttttaaatctaaaacaatataggggcaaatataatatagaagaaaaaaagaaatactactaatgtagtgttgtatttatctgtatttttatttatatctaatattaaaagtcctctattacaattactacatgatattttatttattttttctataaaaaattatcggaaatgtaacatggttaaaaaaattatattgaaattaatagatggtgtcaatgaaaaattttcaaaatattaaatttggcatgtgaaacctaaataaacaaatatatgtattaaaaataaaataaaatatttcgtaaaaatttaaatctggattatagtttatcaaatagatgattatgtaagttttccgatccccactctaaagttatcttcccaggcataccctgataggggaacttttaaagttcaaacctccccaaggaggacaattatcgaaagagtttattaattgcaatagtgggcgaatgattaattataataatgcatttaagaatcctctaatccgtaaaaattgaatactaggatttataaaaaatttaacatattttattcaaccaactcagtagaccccggagtaaaaccaatgcatttacgaataggacaacacttatatgcaatattttttttaatgtatttttggtattaatatttatttggaattgaaatttcaccttaataatttatataaaacagatttgtatgaaagagtcgacataagttatcaaagaaaattttcaaatttaaataaaaaatacaaaaaatcaaaattgaagcaccacatctaagtaagttttatccttacgaatactataaaacatgcatattttaaaataaaatagaatacttcatttaaaaaattttaaaagctgatacttttattttttatttgaaattaaggtttatacttttatttaaaatatgattatatatatatatatatataacaagtattaaaatgtaagcatctctataagcgagaatttaaatcttgatttgctacactgacttttcctttacctaaaacattttttctgttttattttttagttttcaaaagacttaaatacatgtttggtttgtacaatttaatacttttttattttgttcatgtaaatttttttgttttgttttaattcttacaaaatatctgtttgttttatttatttttttccttaaagtgtgttagataacacaatgacaaatatattatctaaaacaatttaaagataaaaaataaaacaaatacattttacaatgactaaaataattttttttcataaacaaaaaaaaaatatactaaattatatgaactaaaaatgtatttaaccttttttaaaatgtataattcatgtataaattatgcactttttattttgttgatgcacgaataaattatgcacttaaaacaatatttggtacttatatttttattgatgatgatacacactgacttatgaactatgttattaactatttagcaaatctcttattgggattcagagcttgcttggttttaggtttgaaaccatcaaatttgagtttagagttagtcaaatttaattatgattttgatcaatatatttgacactttccggttaatgtgatctaatggaataaacttaagactgggttgatgttattttaagtatttttgtattaaataaaaaatatatattaaattttaatcctaatttgtttttataatgaaagcattcaaacatatatcatatcactttaaaactaattttacagaatcaattttaatactcattcaaatagatactcagtttcttcactacactacaaaatcaattttaatactcattcaaatagatactcagtttcttcactacactgagttccttcactttaaagaaatgcatatttagccaccttattgtattttcttagaggagcaaacttattgtattataaatcaatgatagttgcatttttatataaaagaacaactaaatccccctttaaccaacaactacagattttgagaaatgtattgatatttaatattaagattgtccctatataacaaactaattatcataaattcattcaaacacatgctaaaataaaagtttaaatactttttagtccttaatttagcttttttgtttttgtttttgttttcgttcttataaacattttttgttttgttttaatctttttaaattttttttattttatttttcatcctcaaaatgatttagataacaaagaaaaaaatattaaattacaagaaacaaaaaaatatataaacctaaaataaatataagagtaaaagatatttatttatttagctaaattgatctaaacacgcagaatggtagtaaaacaatgtttatgatatttagacacttcacaattttatatactctattaacacgtaattttcctcaatctcgctctttctgttatatgatatttgtatatgtgttagatgtttaagaattattttttataaaaacaactaaaaatctatatttttttattcagtttttattagcgtgagaattcgaattcaccatctcttttcacttgtttcttaagtttgtttggataattttttaaaaaaatacttataaaataataaaataagaataaaaaatgagataattttttctataaattaaaataaaatttctattaattaatttgtaaaaactctctaaaaaaattaaaaattagctaataaataactcattatggagaattttatgtaattttttttctttttattttcttttctgataggttctttgagataaacttgcctagatagacccaaaaatgtagatttgtaaaacccacaacccaatgatacaaagtccatgccttggcctcccactcgtttacttatggctaaaacgacagctaatcacgcaaaactaaataaatgaaatgagaaccatataaaaagaaaaagtcataaagagtaataatagcaacacacgcaaaccaaatcaagtaagagcgagagtgtgatagagagataatgcgttcttatggcttaaccgtaccgggaagcgaccaccgcttctgcgtgcccaccgtatctcaggtgttctttaggcccaacaggcccattaaccgaatcgcgtttcccaaggccaccctcaagaacgacggcttcgtggtggacctgagcttctacgaccttctgggaataccggaatccggttcggtaacggagatcaagaacgcctacaagcaactcgcccgaaagtaccacccggacgtgtcgcctccgggtcgggtcgaggagtacacaaagaggtttattcaggtgcaggaggcctacgaaaccctgtctgatccttccagaagagctatgtacgacaaggacatggccaagggcattaacttcgccttcaacgcccgcagacgctataattaccacgatcaggtacgccaacttagggcttttctactttagcgtttaatgggattggaatttttcacaaaatagttgttgggaatcgcatgatttagccaccgtaggatgaattgcatatggctttcaattgttcgtaatgttgttgtgattctatgatttgttgtgtgtttttttttttttttttaataatcctcatcaaagatattgaaattaaaataatattaaattgtgaaatgaaaagcaatcgggatagtgctgctttgtccatcttgtttgattgtttcgttgctttgttttcattcttttgagacaaggactctttacagtctctcgctatgtgcctgctatttggttgttctgttgctttgttttaattcttagatgacaaaggatttgcacactaacactaacactaacccacccaatcaaataacatattacatattgatattttttttttttttcatttcctagttcaaaattattacatcgagcactatacatcgcttatctgatatatatacctgggctatttttcactctgtgtctaaacttatgatttgatgagttagaattcacaatttcaaaaattaacttggggattcaaaatttgatttttgatttaatctaatccgaaattgttttactaccgatttgtttactgtaacctatctcagtcagcaaacaaagaaattgactgtaggagtgtcatacaactttgaccaggaatgggaattgctttatcatgcacttttgaattctgatattttgtatttcggggtgctttttataagttagtaatacgaacttgattcgttctctgttccatgccttttgttttccaaaaattacagttctagcggtcaccttgcttctgttggaatttctttttcatgatggtatcgcagattcctcctgctgtttgtgaacttatattaatatttgatgtatctattacaaatttgacttctgctctgcacctacccataattgatatttttataatttatgaggactatcctggcttttgttctttttcctttttgaatatgtcgacttgaatcccaacctctccgtcacaaaatctgaacaagtgtgttgtagttggttctttagcacatgaaagtctgttgtccaagttaaatttcttttcatgatggtataacagattctacatactgtgagcttgtattattttatgcaatatcgattaacttctacactgtatctatacacccaatcattctattttcataaattatgtgggctttcggcagatacttccttatgacattttcctggtatgaataaattgtttctggatttctattatgttttttgttctgtttccattttttttatcttcttgaatatgccaacttcaatcccagctcaccaccataaaaactgaataagtgtgttgttgctgtatagcatgtgtaaattataattggctcttcagcacattaaaagtctgcaagctaacagtgtcagaggatatgaatattagtattattaacaataataataataatgatgaaacgtgtctgctaatgagattgagtgtgatcttaattatttctttgttcatatactactgttcggcattttttttatcgtggtaatgactaagtgggaattcatgaatcatgcattctaaagagataggaacttcttaatttattgtatttgtttgttcagttgtctaattcacagtgagttgttctcatgtaactttttttttccttctaattttaaattgaagaaaagggggtacgggtgtttggctagaagtagaacactgattctaagctgttagttttgaatcaggtagttgaacaaaaaagtgaatggaaagctaggtggaaatctcaactgtcagagctgaagagaaaaagtaacggcaaggatgctggagggaatatgtcatgggcggcacgaatgcgccaacagagggatgaattgtcaaatgaatcatgactaggattttccttagttctctctacgtaactagttgtatatatagataatgggtacatcttcgtactctagatcacaaattaaatataaaattaatgttgagaaaacgtgccattggcctattgctctacttagagttttcagtgtgccaaccacatattttgctgaattaacgtctgtaggccattttagtgttttggttagcatttgcaaaattgattttgaagtaaagtgatttatagttagatcattagatgattttattctaaaagcaagttaataaaatttagtatacttttttttttatcaagggtcaaatatgatcgaattttatttttgataggccaaatatgatcgaattaaactccacaaattatacaatttggaagcccctcatgaaattgttatatggttacttatttcggctgagaagatttctggggtgcctaattatgtgtaaggtgggaggaagaaaaatattttggacttgttttgtttcgtctgaatattttggactttggttaccaacaactcaacaagtgggattaggaactttcgtttgcgaatttaaatggacgaatgtcaagggttaaatatgattgaactaaactccacaaaccatacaatttgaaagcccctcacgaaacgtgttatattaagaaaagatatatgtgtatgacgctagggtgatgttgttcgaccaattgatatatggaaaaaccattggtttgattaattatgcggtggttggaagtaggaatcagaaggaaactggccgaattgaatgagcaaaataacatacagcatgaagcatttatggttcggaagctaatgaatatgaaatacgaataaggtaatgcatttgagcatatttcaagatgttgtgaatagattgacgcataaaagttacattaggtgataagttgtgagcatatctatctactccttacttttagacagatgaccagttttgtcaaaaaaatttcactaatcactcctactaatatttcttctttcaatcatatttttttatttaaaaaaattttgaatttaaaatcttacttaaaaaaatcaaatttaattttacttgggccaacgattttttgattcacattgattattttaactttaaattgaaattaacttcacattatattgccaatggtacataccatgttgtcttgtaaaaagagggtatgagtatgatttcccatgaggcacacttgtcccttccccgtttccatacccactcgagctcaagagagaaagaaagagcaggattaatttgcatttatcaattaaagttgtaatgttaaagtgttgcaaatttgtaacttctgataactttctttatgataaccttgaagttaagggtgagtggcgattcttcccatttaagagtcatgagttaggaaaactaatcatttcagtttggggataaagaatgagacagggaatgggggaaattaagaagattttgttcctaatttctaatcacatatgatagcttcaaagttaggcttttcatcgacaaaaggccaatctagtgagatggccctccttacactcctcttttttatttccaacaatgaaactgataattattcaaaaatacattacttacttgcaaccctatatgattaataaaactcttagtagaaaatattgttcaccatcttagaagcaacaacacttggaatatgtaggtgagactatgaagcatgtccctttcccatagcctatgaacttacagtgggcatcacagcttggagtgtctttgcaggatgcaagacaaatttgttggcttctcacagcatgtgaaaatagaacaataatcatggctgcaagaataactttcaccaaaatcactgaaacaagagaatgagacattcttgtgtacgacactttggatcctgtgtgttgtgtcttccttttttctgagtaatgagtggagtgttgcaaagaacgaaaaatagtccttaagatttacatcaaaataaattaatgtagtatatatattgatctctcaaagagaatcaagtgtaatttttaaaagaaacgggagtattgtgttgtaatatatattgatcactcaagagaatacaatgtacattttaagagccaagggactactttgtaatttcttcaaaaagtgagaagaatgttgataaaattttgttttaattttttaaagtcacaaacatatttttcaatccgttcttgttggacaaaaatataatgttctattagagagtaattgttgtgtgaatataataataccaataaatagaataaatcaaaagcatctcccaccaaattggtaactaacaatcctgttgacaacaatcagatgaataatacctataatatccttcgttacagtaataactcatactaaaaaaaatatataaaattttaaaattatattagtctaaaattacatcacgtatactaaataaagttaaataaataaatttttacataaattaaaatattatcttcaaaatatgaacatctaaattaaattaacactaaaaatataacaaaaatgaccacatatgacgttttgttttgaagtattaaccaagttaaaataaatataattaagaaaattatttttttaagttttttcaaactcagcaatttttttgctctgaataaaataactaacaagagttcgtaaataatattgttatcaatcgacgcaataatcaagaaaatcaaacatggtatcagtaattaattttaaataagattatatatatatatatatatatatatatatatatatatatatatatatagacaccccaataaaaatcatattaaaacaattataattcataatattcagaataaataaaaatattgaaataaatggcaacacctcatcgtattcaaataaatataattgacacaactttatactcaattttttggttcctggaatgacatcccattgtcttctcatcatatagaatctctttttcatcccagatgaagatatatataataatttcatcctcatctcaagtgaagatatttatcttataatctcataataaaatgtacatcatcatcccttctcaaaaggtgatgattaactcataaaattataaaaatatcattctaaaaaaactaccaataaattccataatttcatgcattcaatgataattcctaaaatcacaccacaacaataagaaaaccaactaataatatgaaaccacatatataacaacgattatatagtaatataataattaaggcatataatatttgtaatgattagaacataacacacatacgtacaaattagtcttaatcctaaaggttaaattatatattcatcaattcaatgataaagtcctttggataatatatatatatatatatatatatatatatatatatatatatatatatatatatatatatatatatatatatatatatatatataagaaaacacattttcaagaatttttccactttatttcttgttctacctaagcaaaccattaatatcaaaagaagagatcgtttatgtgtgtaattttaagagaagaaagtgtctacccttatataaaaattatacggaatttaaaatttatttaattgatctttctttatctattatttttattatctttaattataattatctttaaccaatttaatatattaatatactaacatgttttcaaaataaaaataacaatctaatatattaaaacaattcaatatatcttttttttactataagatatacttagatatttttatctaaataattatttgattatatttttgggatgttacaacacttattcacttggttatatttttggatgttacaacacttacgtaaaatctttttattgcaaacaaccttctttgggtttgaaatatggaaaatctataaacccacgtcatttagtgttacaactctttatttagactatacaaatgtcaagatcaagttactatatcaaacataaactctttttaagagtttagactgatatgataattgatggatgcattgttccatggtcggttcattttgaactccaatcttgtctacactaagcaagcggtgaatataatgtacaaaattgtttgtcttgtacttgatgcataaatggcattaaatcgtttccgttcaaactaatgaatctgtccttaagttgagtttgtttcaagatgtgatagaccacacacaccactcattatctatctatattctataaaagccagcagaacttaccattccattcatgcatatccagcatttcattcatactttggtatgtttgtgaacccattacgttcagcttgcgcaaattccaaaatgtcgttttgtgaaaaaataatttgttacttttgcttgaacgattgtttgagggaatctcaaatattaaaacaaacacacacttatacactatactgtgtatagcctttaaaaactataatatgtatattaaagtcaaaagcatcaacactacaagcgttggttttttctacaaaatagggaaaaactgaactcaaccatggttaaaacaggttttctcgtcaacatcacaaatcagaaatgagtatctatgagttcaaatttaattgttacgtgtagaattacgtatccttaaaaaataggaatacaaattaaaccatttgagagaagatcccaagtgtattttattttataagcaaaatatattaatataagagccgtttattttggtataattttaaaatatatattattaaaacatgtaatgtcaacttgatttgcattacattaaatatttaattttttataattaaagtctaaggactttttaacaaattcaatattttagtttataatatacagtaatattttattaaaagagcatttaattcttactcttcctaattcaatccctagtccaacgtctagttgtctggttgatcgttgccgtggttctccctttttggaatctataatgcctattttaaaaaccagtagctttcagtaactttcgttttaatcaacatattaactttatctatcattttcactttgtgcgcgatattataactggaagtctgcaagaggaagatcgattggagactctcctattctcaaggtcttgttctgtctctattgatattgaatcaattctattgatattatattgaagcaagatgttgaattaggattaaattagaaagagtaaggattagaaggtcttttaataaaatattatcgcaaattaaaaataaataataaataaaaatatcatatttactataaaaaaaaaagtctttagactttaattatataaaaaaataagtatctaatgagagaatgtaagtcacctaatgttataaaataggttgtgtatcataagaaaagttttttatatccttggatggattttactcatggacaagataaggtgatctcaaatgtagggcatctctctcgacaaaataataacaatcaggtagtccaagtctccaacaacgtcgtcttgtgagcagatgcatcttaaagttttaattattcattttatttttattatttttttagttttaatgtatttttattctctaaaatttatatcttaattctcaaatgattaatgattaacaaaattataaaaatttaactgtagtgttattttttaaaattaaaatataaattttaagaagtttacttattaaattttaataactaaaaaattgaaactataaaaattaaaaatgataaatttagaaattataggaattaaaattaaacaaaaaatatatattaaaattattttaattttttttaccagagtctctctactttcattactttgtctcttcctcgctagcgacaattcccaccaccaccacacccccaatctgactatctccttgtcccgctgccactcttttatctctttctagttttttttttcagatctgagatgtgttgtcaagcttctctttcttttcatgcaactgagtattttttccgatcttagatccacttcacctcttctctctttctcatctttttgggttttttttttctttccaagtctaagatctactccaccacatctccccctttcctttttttttttctaggttttttgttcagatcggtgatccgcgattcctccctcgtcttttatgttcgcgatttgattttttcgtgtgtatttttttatccggacgtgggtttgtgtttggggttgtttgactgtgttttctgttgttattgagaaaggggaaagagagaggaaataagaaaaaaagaggataacaagacgaggttggcggcgactgggagaaactacggtggcgacacgtttgacttcggcgttggcacgttgattttcaaataattccgatagcggaggtcgtgggcgttccccctatggcggtagttaccggcgaaaggacaatgtcgagggggttgccaatgcaaatttagaaataaaaatagcatatctagaaaaacaaattatttgtgttgtatgtgcgatgatgtgttgcaatgcttcaaattgcaagaaaatcgtttacttgaatacttttctattttaaacttttcttcaacatcttttttttttatcattatctttttataaatcctctagaacttgtatttttttttcttttttattgctctctcgttagatatctaattatgggacaaatttatatgaatgggttaatttaaaaaaaaatataagaatgaataaaatttaaaaattataatttatgaatcgtgttttaaaataagattttatctttcttattttttattttttaaaaaacattaaagtcgtattcacattcatgactcctaagtttttttaatttcttaaaatataaatatgttgaaatcattttgtaaatcaatattttaatattttatatttcttagttttaggtgaagtcctgagtgcaagtgcatagggcatgcatcatttctcttctcaatttttttttaaaatataacattctaaaattgtgtttcaaaacatcatttacccataaattacaatattttcaaaatctactatttctataattttttaaaagaattaactcattcacgtaaatttgcccattatgtggtccatttatctttttcctttcagtccatccaaaattattaatatgtccctatgactattttgttttgaaatgtaataaatcacacaccggcaaaatgatcttaaaagagattttttttacaatcttatcctcaaaagagatccttttgaaacattttccaaaggaatctatttttgtaagatttttttcattcccattgacgaaatacattatgtcaccatttcattaacataacaccttatgttgtcattatcattatgtatgtgttatgtgggttatgtatgtgttatgtgggtttcgtcatcacctttgacgaaacacattgcatttccatcatgccttgccaccatggccatgcatgcacatccagcatgggtttggctaatggcacggccaacgtgttcagcatgggtttcgctttttttattggtgaaacacacatgcatgtgttcccattttcacgtgcttcgtagccattacttttcacaatcttttactattaaagcatctattttaaaggtgaaaataaggcaaataaaattacagcgaatttgataatttaccagctattgaagttgtaaaatgagattagctttcatttattaacaaccaagtataagtgtataacgcaaaatcttgcagcaaattgtgacaagtgataacagcaatctcgtgcactaagattaagattatgtatgatgaaattaataagaagttaaaaaattaaattattgaattataagtatttagtaaaattagttgttaaaatagtttaaaaaaatattgaatgataaaaaataataaaattatgatatatttaaaaacataaaaaaatattaaaaataaaaatgaaaaaaatttataaattattattttaaaaatgttaaaaattacaaagaaattattttaaaagaagtgttaactggagaatcaaataatttttttttatttttagttagtaaaaataattaaaaattaacttaaatattttatcaaacataatctaaattgttatcatattaacttaaatattttatcaaccatccctaatttaattacaatcaattacaatcgtatttaatttttttcgtttccgttgaaatcaatcatgtctaatttaactacaatcaattacaatcgtatttaattttttccgtataatttttttcggttaaaatcaaccatacctaattgcgatgtgttagaatgcttcaaattgcaagaaaatcgtttacttgaatacttttctattttaaacttttcttcaacatctcttttttttatctttttataaatcctctagaacttgtattttttttcttttttattgctctctcattagatatctaatagcattatgggacaaatttatatgaatgggttaattttaaaaaaaattataagaatgaataaaatttaaaaatattataatttatgagtcgtgttttaaaataagattttagctttcttatttttatttttttaaaaacattaaagtcgtattcacattcatgactcctaagtttttttaaattttttaaaatataaatatgttgaaatcattttgtaaatcaagattttaatattttatattttttagttttaggtgaagtcctgagtgcaagtgcatagggcatgtatcatttctcttctcaatttaatatttaaaaaaaaatataaaattctaaaattgtgtttcaaaacatcatttacccataaattataatattttcaaaatctactatttctataattttttaaaagaattaactcattcatgtaaatttgccaattatggggtccatttatctttttcctttcggtccatccaaaattattaatctgtccctacggctattttgttccgaaatgtgataaaccacacaccactcttctatgtataagcctgcagaacttaccattccattcatgcatatacaacattacaacatttcatttcataacatggagcttcttattcccttctctctcctattcacctttgcttgcattctccttgcattgttcaacactctgaaccgttcaaattccaaaatcttaccacctggaccatggaaactgcctcttcttggcaacattcaccaatttttcgggccacttccccaccaaactttgacaaacttggctaaccaacatggaccgttgatgcacctacaacttggtgaaaagccacacattatagtctcttcagcagatattgccaaagagattatgaaaactcatgatgccatctttgccaataggcctcatcttcttgcttccaaatcctttgcctatgacagcagcgacatagccttctcttcttatggaaaagcttggaggcaactaaaaaaaatatgcatttcagagttgctaaatgctaaacatgttcaatcactaaggcacataagagaagaagaggtatctaagctagttagccatgtatatgcaaatgaagggtcaattatcaatcttactaaggaaattgagtcagtgacaatagctataattgcaagggcagctaatggtaaaatatgcaaagaccaagaagctttcatgtcaacgatggagcaaatgctagtgctgttgggaggtttctcaattgctgatttctacccttcaatcaaagtgcttccattgctcacaggaatgaaaagtaaacttgaaagggcgcagagagagaatgacaagatcctagaaaatatggtcaaggatcacaaggaaaatgagaacaagaatggggtgacgcacgaggattttattgatattcttctcaaaactcaaaagagagatgacttggaaattcccttgactcacaacaacgtcaaagcactcatctgggttagtatgcaattttctttaacattactttaagattcccatgtatacaactatatacgtccatagatatgaaatttgctgaaataataacttacactttaatatatatagagagagagggagagagagaaaattgaagtagcgacttattaattaaaatattctttctgagcaaataagtgagtgtaatgtactcacttgtttttttaggagtattctagaaagatatagtttctgatcttaattaagaaaatggttaaatatatttttattcttaattttttaaaattttttactttaagtctctaataatacaaaattgaccaattttagtttttgatgtttttattcattaacgtttttagttccttcatgtttagttaaataaagatgtgacaacttcaataaatgtcacgtgttcattttattgtgacggtcattttgtgagggttgaaaccgtcagaatttgctttgtacaaagtcacaatctccttcaagctttagccgtcatagatttccaacaaagtttcatggtttttttaataacacactaatacagattcatagcagtagcacatagaaaaatcatagatacaaagatccaatttgggtgttaccttcagagagcattgaaatcaagaagtaaaaaataaaaaacaagttcagaatgaaaaaaaaaaaagacccatttgataaaacggggagaggtggtgggcgacggccgacgagatcgttggagaagtggcggtggtcgaatttgcaacccgtgttgattttgccactcacttttgttttatttatgttagttgaatactaaaacatttgtgttcttgcatctagatttaccacccgtgttgaatttgtgctttcaacgtttgaatttgttcttctgtcaaatatatgtgcaatttgcacctgagtataacaatttcttaaggtgtttaacatcacattattatttaacgccaatatttaacggcaagaatcaaaatttatataaaaaaaattaagattgatcattttttttattgaagaactaaaaataaaaattttaaaaaattagagactaaaagcataattaatgtttaacaaagttaaagttgtaatggttaaaatactttatccataaaataagtggataacaactctatctttttctttctttctttataaaatatatttaaattgatgataaaaagtgaaataaaataggaaacaaaaattgatattttatttttatttttattactattagtagtataatagaaggataagtagtgaaatagattttctttcattttgttctattattggtctttttgttcctcttaatttaaaagatatgtaatggaatgggattttcatttcaccctattataaaataattaaataataatatttttcatttcatttattatatttcatcggattggttcatcctttaatatctaaatgaagttaccaataccaggaaaaatagaacgaaccaatcccttggacccacctcatcactgccccagttgctaattggctacatttttattccttggccaatttctagaggggtccctaaattatttgccatcttggaaaagtcttcaactgccccagtttccatgcccattttactttgtttatttcccaaaaagacgtgagtgaggtctacggcaaatttctcaaactaggttacttttagaaactaatttctaaaagggggctgttttaaaacttttttcggaggagtctgtttttgaaggggattcgccagcgctgttggcgagacggacacctggcttcgcctggtgggactcccaagcggcgcagcgtaagttgctttacccttcgacgaaacgcgcctgtagtcccaaacaactccagtttacttgcaaagatcttcttgtgtatcggaacccgtagaactttttgacggggggagttaataatgtggtgcgaccctcgagctcacgaccgcactcgtactcgcgatgcgcctaccaggcaggtcacgnnnnnnnnnnnnnnnnnnnnnnnnnnnnnnnnnnnnnnnnnnnnnnnnnntgggcctcaacggacattcctatcaaaagttatacgcgtttgaagttaaaaaattttttttccgtaaaaagcatttcgtcagtacgagcggcgggacccgccacgtggacaacaactcgccaaccccactggcgagtccaccaggcgctgccacgtgtccaactcgccaaccccactggcgagtccccttcaaaaacagacccccccggaaaaagtttcaaaacagcccccttttgaaaattagtttctaaaagtaacctagtatgagaaatttgccgaggtctaccttatttttattttttgggcattgtgatgcgacgtcgcataagccactattacatatgttttagcaacatttaactaattaatgttctaataagtaataagaccgttttgtaacatttgttaaattaaatgttagtaaattgtgatattgtttttctatacaaagttaaaatattgtcaaaatattttttgttacattatgtctctaaccgcacctttgttcatgacaaagttcccacatctctcacgccaacttttaccctctattcttattcttctcacgtggtagtttcttatgttgttcagcctataaatatttaaaaattaataaattaaaatactatttgaactttttttatatatgaaaagttaatacttaatagtagtaattgaaattttcggaacgagttaccagctttggactgtacagtaatccttgagaaatctctcctaaactttttatccatacattaacttcctcaattatttaaaaaaacttacactaacatcttttatacattacattaatccgttaattgtgtcaccatgtttcccacaaagggagattgttgttaatattaaaaaggagtttgtacaattttactctagagatatcaatctaatgtattctattattaatgttctaaatataattgatgtattctattaatctaatgtattctattattaatctcaggacatgtttgttggtgggacagcagcaccagcagcagttacagtatgggcaatgtcagaactcataaaaaatccgaaggctatggaaaaggcacagactgaggtaagaaaggtcttcaatgtgaaaggttatgtggatgaaacagagcttggacagtgccaatatttaaattcaatcataaaagaaacaatgaggctacacccccccgaagcattattactcccaagagaaaacagtgaggcatgtgtagtcaatggatataaaatccctgcaaagagcaaagtcattatcaatgcttgggccattgggagagaatcaaagtattggaatgaagcagagagatttgtgccagagaggtttgtagatgactcttatgacttcagtggcacaaactttgaatacatcccttttggggccggaaggagaatttgtcctggtgctgcattttccatgccttacatgttgctgtcactggccaatttgctttaccattttgattggaagctgccaaatggagcaacaatccaagaattggatatgtctgagtcttttggcctcactgttaaaagagtacatgatctttgcttaatccccattccttatcacccaacatccaaactgggccatctataaaaactataagctgaactgagtgtgtgtgtgtgtgtttttatcattaactaggtgtgtttatttatctttatcaagtgtactagaatgtacgcatttatttcccgcactcctagtgttgcatcagacacctcaaaagtttatttcaaaatgtaaatttatattctaaaataaacttttggaaatgcaataggagatgcagatataataacctagaacgtatggtgataagaacaccatacattgatggatggtgagagtcaccgagtctcatgttaactatcataaaatcctttcttgtaattgagatatttataggtatttcctctatttattcttttacgaattgcttaagctgggatatttttttcatgaattaaaatgaattttatgaaaatataaattttagaatataatatttttatgtttgtttcacgaataaaaacgaatttttaaatgttcttatgaattttgaaaaaatattctttagaagaaaatatttatataatgaattgagtaacttttatgaaattgtaggaacttatgttctaatccaattgtaacttacattttaattttaatttttaattttaattttaaaaatattttaggaatattaaaatctagctagtcaaacacatttttaaatattttcaatgaatatttttaaattagtacgagcatgtttgtttcatgggcgagaacgtgaatttgggaataaattattttcatgtgttgtgagtaggttgtttaaattcaaaataaaaatcaaaaaccattagaaaaattgaaaattaaaccaaatcatttttttttagatttatttgaatgattttttcctcaattaattggtttgatctagtttgtgatttatgtttttgagaccaattcaaatacactctaggtatgtataattatatatataattaatttatcactgtttactcttatcaataattgattactgtttactcttcaatttgttctaaacatgtaatcacttatcaataattgattatttctactagttttttttataaaaaaaaataacaaataaaaagtaatcactttcaaacatgtacaaagagagcaatgataagtgctcctttattgaagatgataggtttaaacttcgtaccaataatgtggcaaaagataaagattgacggatgtcctcttcaattattgttacagagaattattttgtcgggtattttgatctagaccgattctatcactatggttttttaagagaaagattgtttcaatgttttattgtttttaatttttaaaatataagtaattatttttttaatctttcaaaaaaatatttgtattagtctcttgaattttcaaaaaattatttttagtcctttttttgcttattatgttcataatttgataatctgtgataatttttaatcactaaatttatgttttttaatttgtttttttaattttgatgattttaaatcgtcaaaatattatatttttctcgtatgatttgatcaccgtcttttacacaatcttattattttaaagaagaaaaatataaatataaatgtgaaattcttgtgatttttttacctattctagaagttttaaaatatcttaaatcattttaaagaaattaaattaaaaaatatttcttgacggtgaatttattaacaactcacaaagttaacatgcggtcttaacattttaaaagtttagagactaataaaaacaattttttaaggtaaaaaaatatctaaatttaaaggattaaacacgtatttaaatctttttaattaaatagttaatttattaacaacccacaaagttaacatgcggtcttaactcatccttaagtgacaattgcatgattttgtggcagaagtaattgaggttgtccttgtttatcatcgtctcgatgctaaggataaattcatagtcttagaccaataaaaaattagttaatcagagtaatcagaaaactatatatattttgtctttgtatgaaagtttggtgcctctcttaagtttctttcaaaatagttatggaatgaatatgatatccattcagaaaattagagaccactcaacgttgttaggcttgggattataatcaagtctaaatcaaatacacatccagtcccaggaaaaaaatgatttaattagatttggattttcctaattagctaaagcaaaggtgggtttgtaaaatgtcaattgtttgtgcaaagcaattaagtccttttttataatatatatatatatatatatatatatatatatatatatatatatatatatatatatatatatatatatgataacaatgcataaagaacaatcacgccatgtcacatctacatttatgacgaggcacgcttgactttaaaacaataaattatgtattacaaactgaaagttttccttgctcacagatacatcaaataaaaaagaaatttattcattaacaaatatttaatgcgtgtttgggtattcgacgaaccaacattggtgaaaaatgaagtttgcaaaagcatctccatcattccttttgcgttaatatacggttgaccattgaatttaaaattgaaattcgtgctaacaagatgaacggaaagtcaaacatgcttttaatctcattaaaacttaattattctcaagcaaaagaccaattatcttgagctcagatttaagcttcaccatttcatcctccggaaaaatcatggtcagaaacttcccatcaacaccattctccatagaacctttgggcaatggatacaccaaaacaaccccttcatctccaacaccttgaagggtgtagtaaacaaactttggtgtgtgtcccttcaattgcaagtcatacacattggtttcttgtaagtctagaaatgtcaagttgacaccatagacgaagaaatcactcacaccttggtctctctcaactgcttcctcaatttgcttcctctcatccacaccttgatccacaagcatgctagctaaaactgtcaaatcagtgtcaagaattgaggattcacttgcagcatcaaccttgcatatcacttggttgttaccaatgatatgattgcccctcttataggggttgcttctacacacagttacggttttgggttcggatcctggtcgaattcgggccatgcaacgccaaatcatggcacatagtgattcaaaaggaggggtttggtcaagacttgtaccccaaatttgtgcttgcaagtagttcaactgggagctagttaggtggaaggagaatgtctccatttttttgttgttggctggaatccaatgatctcccaccgggtcgatccgttttgctgaaactggatccttttcaggtccgggctgtccgggtgttgggatggatcttgggatgttaaaaagcatttttaggcccatatttttcaatattagaccccaagagttaatgaattctgaagccgaaagaggatcccccaatacgtgggcccaactaagacccaatgaaattccgccgcacttaaatttagtcacctgcaaaagcaaggttgtctgactttttattcaaaagtattttgtgtcatcattctctgcatttattttttttaaagaaaaataaataaactccccggggaaaaaattctcaaagttaccgggatagtgttggaggttggcgaaaaattaatatgatttttaattttaaataattatatattaaaacaaatattttaatatttttatgaaataagtatatacgctaatttatgtaggctattaaaatacaaattttaaaaatatcatgaatttaaaaaagctatataatatatagttaattttaaaagttttaatttaatgtttataatggcatgtttatgctttatagtgatagctagaaggaataaccatctagaaatatttttttcagattttttatttatatttcgtttttaccaagtataaaaagaaacaattaaacgtatttatactcgtttatctaaataagattttcaaaattttgcttctaattactattattgtagcaaggatggaacattttaaaaacggatatgagacatcaataatattaatgtaattgtcttttaaacaacttttgatcatatttaaagattataaattatgcctctcacctaagacgacatctatcttaattttttttttcggaaaccatctttcttaacctgtcattcccttgttcgtgtattaagcattaaaaaataaaaacaataataattttgccgtattattcttttcgataaattgtgtttgacaatttgttgtgtatatatgtagaattatattaaaatcctcaggaaaatagtctttaactctttatcgaattttaaacgtgttaatgataaacttcattgtataaaagaagaaaaaaaaaacgtgttaatgattcctaccagtatcgggtcatttatataaaaagagtctgatagtaaattcaaacttcattgtataccaaaaaatatgtgtatgataagatttgaagataggtttaaatactcctataatatgtagtactactattaaatattaagtaattttttataagacattaattgcatttattttttcatataatatttatttataaagtgttaacaaaactataagaagattagcattacttaaaatcaaaatattacctcggattttattttatttttataaaaaacaagtaatgatgtattttacagtataaaggaatccttattaatgataccgagggcttttagcttacggtctacagaaatattcaaatatgtttggatgcaccttttttctttttttgttgaatagttaagatctaccttatctctcttatgaaaggaatgtccaccatataatactatttgtattaatgtaagggtaacttatgaagataggatgctattaacttctctaccagaaaaagcatgcgactaattaacaggtcactgtttcaaccaaaccaggacatgataaagagtgttagggtcctttcgcacgttttattgtactatattgtgcagaggggcacattaaatgaggaaatattttaatcgttcattaaaaatgtatactagttgagaataaattttaacaattgtgtgatttgttttctgtatatagtcatatatttaagtttagctgttaattttttaataattagttataactattttttaggaaatggaaaatacagagagaaatatgattttaaaatgttcttatttaaatttcaaatatattttttttctttctccattttattaatgtatcaaagattcggtaaaacttaaaagtgtcagacaaacacgtgttgcacagctgtagtcaccactcactagtgtagcaggactaaaccccagctagctagtagctactctttttatggcattgactacagtatttataattactgctgtatttataatgtgtttggccattttgggtgagagggagaaagagagaaatattgaaaagaattttggccattttcttttcccgtaaaaagtagatcatcttttgaaatgttaaatcaatacagataaaaaaaaaaaacagtcctcaacaacagtcagtacccaaggaaaatagctttggagtaccaattttgtatctagagaaacttataatatatattttttttatcattaacaagtaactttagcatattgattaaaaaattaaaaaatatttattactaacataattacactttttatccttaacttattattattttattattattgtttttacaaaatttctccaactttttaatttttttacaaattttactcttaattttttttgacaaatttcatccttaacttttgtgcttattaatagataaaatttataattttcttaaaagttgaagaaaatgcactaaatcaaaagttgaagttaaagtttgtcaaaaattaaaaaaaattggagtaaaaactgtaattaaacctaaagtttaaatcatatttggatggtgaaaaaataattttaactttattttattatatatgtttgataaaaatcactttaaaggtatttataactgaatttcaatatcaaattttctgtttgtcaagaaggcaaaagctaagctatttcttcactggcattcatctggtaaattaatcaaaatataaatgtactttggtttacagtgaggaaattacagaaatgaaaaattctgataaaaataacactaaaaaaatcgtatgaaagtagtactttgtaatatttaaaaaaatgaataatatgtgtgtgtcaggtgtgatgcatcatatagaatgtttagggaaattattaagcacctggaacaaaacaggaggagaaaaagatagttctgggccaatgacttggtgagagacgagcaacttgtacaagggccaatccttcatggctagccactcatctagggttttgttgcacttggcctcaatgaaccttgctccacaatcattgcacttgattaagggtcgaccggaatccgatcgccggaaccggccacaggtgatgaagtaatggttgaacaaagtgaacatgccatccttaattttcatgatggttaggtcttgtgcagcctcactatcaaagaagtacaccactctaaggtagtgaagcttcatggccaagtccaagccacccgggttgtggaatacgtccgacccggtggcccggcccggcccaactgaggatagcctcacatcatgcactacactctcttctaagaccattttttggtttgatcctagaaattaaaagagagagatatcacaaggtcaagagggtttggttgtgtgttgttgttgttgtaagaaagtgaatgcatatatatagaatgatgagtggtgtcataagtgagggaccatggaatggctagttggagatttaatggaaactttctatgcttttcattcccattgggtcgtaccaaataaacggttagaaacgatcacttcctaattgaagtaacataaatattttttaagaaaattttattgtccattttacaaaactcttatttaattattcttttgtattgattattttcaattaaaatatccttaattgttttagtccataataataaatgttataaattatctttttatctctcttatgaaaattgaatatattaatttaaaaattgaaactcattgttattattattattattattctctctccacactttaattaattaggtgaaaaataattagaagaaaaaatttaaataactagtcccactaattttaagagtaattttaggaaaaaattacaaataaatctaatgtatcacttaaattaacaaatttaattatcactttttttttctgtaaaaaacaattttttaaatatgtttaaattaattataaatgtcttatattcataaacgaaagaagtttggactcagaatcgcttaatgcaaattcaaaagagcagaaaatattattaataagtgcattaaaaatattagtaaaaaattaataaataaacgaatttatcattaaattcgtattggaaatcatgaaagaatttatatattcttttacaacatttataatgatttggaaggagtaatattacatttttcattaaaaaatttacattttttgttagcatttttcatacactcctctttgtttctttttaattgtcagattatatttgacaatgttttgtttctttttttatcctgttttttgcttttttctattctgaaaaactgtcatcgtcaaaattcaaaataacgtgaattactttttgttaattatattattatttttacttaatttttaattaatttacacttatgcatttactatagaatagagatgaaaaagaataaaataaaaaaatccaaaactattttatttgaataaaaaaattattacttgttttaagtttttacataaaaaaaactttaaaaaagacagatgagagaacgaatgaaataatttttaagcaaatattaaaaacactggttaaagaaataaaaaaagtaaactttttaatgaaatacgtaaaaatatgtttttctatgacttttatatacgtttttatataattttataaaaattatttattaattaatatttttaaggtactaattattaattagtaatatttttttaaaaaataacaatatcctattttttaaactccgtacttctttctacacaagtatacagctgccaaaattttgatccaaattttgttcggccatcactgtctctctttatccgtatcttctcattagtcaagtcatagtcatcaatttatttcatctaatagttcatattcatgaaaattggtcaatttactttttaaactaaaaaaaaaattcgtcaatttgttcagttattatagtcacagattagttatcgttaataaatactaccttaatcaatactatattaagatatttgttcattagcataaaaatttatcaatattattaattagcgactaatctgttaaccaatctccaaaaacattgaatgatttgtataaataatacgtaatccatttttaataatatttatcaatttagtgataaatatactaataacgaaataaattaactaatcgtcagaaaactatattaaaggcaatcatttagtttgatttagataaaaagagactagtatcgaaaaaaaagaagataaaaagaaactaggggataacttataaagtttgtgcaataatttaagatctcattcgttttgtttatatgtaaaaaaataatttatttaacgaaaaactgtgatatttgacctaagaaaaaaaataaagactaggaaaaagttgactgaaaaacatctatttacatcaaatttctatatataaaaaaaaagatattatgcaatacagtaaaaaaaatatggaatggaataactgcgagaattttcttttacgattcctgctttcccttttatacccggactcatttactactaatgtgataaattttacaggatagctaataagttattgtccctggcccacatccacatggtaattaatattatagcctggtgactggtgagtggtgacatctcgcagatttatagaggaaaattattgatcgatatcatccacattgccaatttatacccagtaatttgcaactaatttctctgtcacaagggatatttgtaatcctaaataagaaaaatgcttatatcatttctatgaatttggtgtttcgactttcaataacgtttgaagttttgaactgactcaaactatggtttggatgctagtagcatcaacagaaattcagaagttaaaagtatataattactcaaactgtgaattcttaaaattcaatatcatatattttaaattattttatttactttccaaattatattattaccttttggttattttatactgagtcggtggctacttttaaaatatcaaactaccaatgtttaagatgtacattgtgattatgagctttccatgtaagaatgaaaaacataaattatccaagtcatataattatatttgaatagttaaaatttaaaatctcattattgcttaaaagagttatgtaaattttttttaaaaaaaaaaaacttgtatgatttgtattatttaagcttaaccattcatataaatcgtctcatccaaaagtaaagcaactgaaattcatgctttaaatccaatatataacttttatttaaaataatatatatttttaaaaatattttaggcctcatttctcattggatccatcctataaggcaggtatactttaaattcgagtaaaatatatatatactcacaagttcacaattaattttcgtgtatatcaccagcttgcatagctgaatacgggggaacatgcacgttcgtgttactgatgcaacgtacaagtatgcaacttatctgaattgaataggcatcactttcatgttcatcaaccttgatcgagtttaaacaggtgtcaatggcctattgatagaaatgaataatgtctgagaaagtggttgaagtgaagatataatactcctactacaatgcatgctgatgtaggtaactaaatctgggttgctaaattaatatgccatcaaagttttaaattcgatgtagttccattggtttatagctgacacctagacacttcattttgcccgttgaactcaaggtaaaatcaatagctttgtgcagctcatgtgtcctgcttagttttttacaatagatcggagtctagctctgtcaagttcaaagttttcgatgctcaccgttgcaatgattttcatttttggctaatgcaaaaaaaagaaaaagaaataacaatttaaagttaaaaggttttataattagctttatttaagcttttgtcatttaattatattgtgcctgtggtagtttttttttagtttttattagtattattttttatcattagatatatcgtatatttttggttgtttaggtaaagtaaaagcgtgaatcaatgctacaataatgaattttgtacacacaatcgggtgcttgcctgagcattctttctgcttcattcaccaacaccttttaatactacaccagtaaaaagttagtttatatataaaaaaaatgccagaatacagcatctgaaattaattgagcatgggcacattggatggcgctacaaattggattcaaaatttctcttcaaatacctaaaggacagagatcaaaatgcagcataatagtgttaggttttgtgaaggtaatgaagttatggtggatggcattcaaaagatttatttatagactaaagaacataaattggatgacatttacccatcttcatttttttgttctctttctcttatctttccttttaggttcttattcacatggactagtcaaaaattttatatcaactaataatatatccaaaatagtacatatataatacgtagtgaacaaattttatcccatgagttaattctctttctcctcttagtttcatcataattagtagtaataagtaagtattgtctctcgattcaattttgtctgtatacaaaataaaccttccaccgtataatagaaaagaaagagatctcctgtctcttggtcccctcaatcatcttttcctttgaacccaaattggaccgattcaattcaagggtagatgaagctctatcaattatggaaggaagctgcttggagcatccaacatttttattggtacatccagtagttttttaaaatgccaaaattatccttatttatattttaaaataaaataattaaaatttaaaaaaaaaactcatacagatcataatccttttaaaaaaaatcaattttaaaattttcaattatttttttataactaattaaaaaataaataaataaattcatacgaactgatgatccgtatgaattatatgaattgacaattcatatattttaaaaaaaaataattttaaatttgttaatcatttttctaataattaaaaattaaaaagattactgatccgtatcaatttgtatgaattcatatgactcatatgaatcatcaatctatatgagtttttttaattatttttaaaattttaaattatttttttaaaaaaagtgattaaaaattaaaaataaaattatacggatagctaattcgtaggatccatacgctgtatgagttatacagatcacaaatcatctatttgtatgagtcatacatattgtcaatatgtatttaaaaaaaaaagtaaatcatattttaatccttttactgtcttactaggttaggagaacaactcccattatatatggaaaggttcattaccctctttatatcctttaatttcttgactccacattctaagtacgttcgttgtaactaattcattcaattggagcaaaagcttttggttttcttgaaaagccatacaatctccacttctttgttatgctagcccaggtcttcatttcgtcaactaatgatgcaataaataactttgttaattatttagcctttgcttaaatttcatagaactgcgtaatctcattttgttaatttgactaaaagaaataaacttgttaataaagttccggtgaagtttcacagaataaattttggttgtaactaattttgagaatttcatcatcaataagaataaaaataatgtcgatccaacaggcctaaagtgaatttaaagaaaaataaaagagttacatgttagaattttttgtcaaaatatttatgatctatatacatatatatcatttttatcaatatatacatggcttttttttgctttataaaaattaataataaatattttttttttgaatttaaagcttaagttttaattgttttattttcgggttgatttgttttttttaaaggaccttttgcgttcatctgaattagaaaattgggacatgaaaacgaaggataagggcaaaaaaagttgtttaatttatgaatccgaattaaaatcaagtgaaattagatcctaatattttaattttttttccttttcagtgtttatttattttagttttttttttcctttttagtgtttatttattttaggcaaatttgcacttttagtcccccagtttatttccaatttcggatttggtccctctataatttaatttacaaatttggtccccaattttataaatctctgcaaaattggttatggaagtccgatttggatattaaccgttaacctcagacgatgactgccacgtgtcaataccacgtatcaacatttgagtagttttctgtaaaaacttcattttttgtaggtaaaattatacttttggtcccctagttttactcaaatttcaattttgatccccttataatttaattcacacatttggtcccctagttttataaatccctttataaattcagccaaattttattactggagaagttgtatttcaaatttcaaacaaaaatatcattgtcatacatgggccacttaagtagtcgtatacacataatatcgcatggagaaaaaaaaaagaaaaaaaaagggagttattacagaacctgttaaagtaagatatctgaaaatttcatactcaagttggaattcatgcgtcactttcccaagttgaacaaccccggaagtgggagagagacaaatagtgatttttctttggatttcaagtgagtgaaaaacttgcgatgaaaaagaagtgcgaaatttatcaagacctaccatatttctaacaccattagctaaaccattcaaaagatcaattttgcaggaacaatttataaagggatttataaaattgggggactaaatgtgtgaattaaactatagggggaccaaaatcgaaattgaagtaaaattgagggaccaaaagtgtaattttacctataaaaaatgaagtctttacgggaaatcactcagacgttgacacgtgacagtcaatgtctgaggttaacggtcaacatccaaatcgagctttcagaccaattttgcagagatttataaaattggggaccaaatttgtaaattaaattatagggaaaccaaatccgtaatttgagataaagtgagggaccaattttacaattttgcctttattttagtgtttatttgaattcttaaaaggaaaatatttaattacttactgttttattatcattttttcttcgtataaaaatgatataaaatttcagctagtaggtgtccaagtaaagttgccggacctcctacgtcatcagtattacacggatcgacatgaacctagctcagcaaaccaggttttgctaaccttgttatagaaaatccctttcaagccgcagggttagatacgtgtcttagttattattattattattattattattatatgtcgaagtcatacttagttatgatagctagctaactcttttattaactataataattggctacacgttgcagctgcatcattcatacatcaaaccactggattccgaaatttgcaaatggccttcccaaaccaagggatttaaaagaataagaaaatacgtctatttagaattgtttggataaatatactcatatacttctctaaaaacacttattgaaaaaaaattaaaattaaaaaaagatattcttcataaactaaaattatctcatgcatgaactaaattgtaaaaattcttccatatgagcttttgtaaaacatgaattttaaattatgaaaaacttatttttttatcctaaaaagtattttttggataaatttatccatgcagacatacaggccttatactaaataaataagggattcttaattttgtacgtacttttgaatgtaataaggatgagttgaatactaaaaaattaaagagtaaggagaatttcttacttttagcataaaaatgttgttatgagtggtaaataaatgacccacaaactaaggctgaaaataaattaaatgatccatgttgggggtatatttgtgtataaatagcagcaaagaaggcataataaataggggagtagtggacttggaacagctcaacagcaagccaacatacacagtggttctggccctgatggtactcgcttctctctctctctctctctctctctctctctctctctctctctatatatatatatatatatatatatatatatatatatatatatatatatattgtctgataataaaaaaaaatgttgtgcatgttcaatgacagaaacaagcttgctagctaggagtttctctgtaccctataattagaatggtgatatatcacttttttcgtgtaatctaaagaagctgtgtattctactgtaagaagaaatttatctgaaatcacacgcttatcccaattctgttgccatttatggagtaatggagatcaaccctcaaacctgaatggtcccgactccccacgttggttcatttgctttctccaatgaaaaattgatatttattattgaaatacttctaatatatactgcacccattcttatataataaattcaatttttatttatcaaagtaaaatattttttcatagtctttttcatccacttagtatcttcaataaaaatcatttgccttttacctattttaattttcattaaattgtaaaactggcacaaatcatttaccatacactctttttttcttcttcttttcatgcatggcgcgtcattcatagtaagagacacatgacttattttttttaaatttaaattttttggattttgtttaatttgatacttcaataattataatgtcaatttattttctacatttattgataaaaaaaaaagaagagaaggttgcagaacaagcctattaacaaggatatgagagtcttcacttcacatggtatggtaattgcagaatgaacgctttggtggtgcatgcatgcagatgcgctgtcagttgtctagtggttagaggctaactcattaaagaggatgccaacagaatttatagcattggttcaacacttcaattcaacggttcaacttgtcaccaaaactacatattattcaatacatgtaccatatgtactataatatttatatcttaatggccaattgctgaaagtttgaatcaataattaaaagtacatacattcaaaataataataattaaaattacatatgatataaatgtgcattctgaattctaaggtgcaaaagaagaaaaaaatacttttaagctccatgttgactttgttatattaatgggttaaaaataaaacaaaaaactaaaaccacacccaatattaatacagactaaaaagggtacatttaaatttactaatatattttaattatttttaaaaatttattaaaaagatagaaataaacaaactttaaaattgtcatcatatttcttttttggcgtgttgtcatattttaaaatacatccaaggtaacatattccttttaaaactaaagtgaatatacgttacaaatcccatacatccaaggtaaaattgtttaggactctaataaaaccacaaagcatagtatttttatttttttttgttgaatgacaaagcatagtatttgacatcataattcgttaagcagacgtacacaaccgaaaacaaataaaaaatcaattgagatatttctcacacttcatcatataaaaatcactatcataacctgtaggaataatatgaatagattgtataattgatttttttttcttctactgattttataatttttaatcaattttaattaactaaaaaatatatgtttaaaaaagtgcaacaaaaaatgtataactaacacttctctgagttataatcttctttagcaaacatttagagcatgcttgtttttcatttttgccgattaaaaaaaatgtttaatttcgcgtttacatgacagaaacttgagtcttaaattagtcaaacttaatttttcatttaccatcatggttgttaattagttacagactttatttggatggtccagactcaagtaagttaaagctatttctaataggttttgcatccactctaacacgagtccataaatttattgcacacatatccctgaatcgcaatagaatataaaaaagtatatatgagtattagaactcattttaataattatacacctaaaatcaattttaattacaaatttccatacaactttgtataacaaaataaattttttaatatttattataaaaaaatcacattacaacaaactcaaactcaagtttacctagaatcgaatctagaaattcacattcattcaaaatcaattctatattataaacacgatccaaacgcacaccaactagtgagaatctttataaatacacgtacaatgagagatcaacacatataagctcaagtaaataaaactaatatttgataccattatttattaacaacgaaatattatgtactgtaagatagttaactttgtagtagtctctttaaaaattaatttggaagaaatttataattaattaatattataaatactgtatgaaaataaaattcaaataaattttcttttatcggattttataccatcatttcagtcagaaaactgaagacttagcttcatcaccacttttgtgttctgcatcagacttggaccaagtggtatctgacacgttcccacgaagataaataagctaatgtgccaacttctagcaaggatggggcgtcattcattgtgagggaccgaaccatgttcttaattattattatatatatatccatgaaatatattttttttgcctcctaattaaattttctacttctatcataaatttggccataagcccagactattctcacttgatcactataactgtaatcattttacgtttgttcttacaaaaacaaaattgtgacttttcgtccctacaaatgcataaaattttagttttgcttctatgttccctgtgcaaacactggggaatagtttaattttctaatcatataaaattgctataaaaaagcattttcatacaaaaactaaaactttttgtttttttttttacttaagtgaggaaaggaaatttcagcctaaggggtgaaatcccaactataggttgacacctggccccctactaggctcaaacaaccccctgaaataccaaaaaacaggatcacgaatgaaacatgaaggaaggaaggaaggttagaactattacgactaaggtcagacaaaataaaggttgggagaaaatcccaaaatgaaatgttgggagaaagtcccaccaacagaaacctgtattatgcacactgaagcctgcaaaagactaaaacttcaaataagaatagctatacaaacacacaagtggataatttaactttaaccattattatgctttccaacgtcgaaccaatacatttaatttaagatgcatatatttcgaacagactttgactttatgtggcttaatcaaaagtactataacgttggacctatatttttcaaaatcatggtagataatttatttttaatgtttgtaacaaaaaaaattactataattgtacccaaaaaaatttattattaatgttcatgtcggatgataaaataatactaataatattcgtgtcttttcaattgtcataatattttcgtcataaagattcacggttgacaaaggaatgattttatcttttaaataaataagacaaaggaatgcttgttttttttgttcagttcattagctttttaatctttcctcttgtttttagttctaggcttggccgtcctttatcaacaaataaaaacaactagcataactctactgggccaaagcccaaatatataagatatatatgttattcaatgttttatctctgaaaaacatgaaggtcaattgcgtcttgcatctccacaattactttctgcaccttttgaagtttttagaacacctaatctagaatgtaaaattatatttcaggttaaccttttcgaaatataaaaataaaactcacataatttaggtatgatatggtaattctagtttcttttgaagtttgtcttgacatgaaaactcactttgtagcaagaccttttagttaagtctataaatttacttgtaaataaattaataagccaaaaattatatgtaaataagcttatttaatcctttaaataaattaacaaatataatctcaaaatattataataaaattttaatataatataataacaaaatattattatttgtacttattaagcttaactataactcttaaaaaaacttatttaatatatagataagttcaaacttcaaatttaaaaaattaatcaactcaaggtttgttaagtctatccttaacatattccaacttatttgcacccatgcatccgtgatgtctccctcacgctagaagaagcgtgagatcccgtcgtgtactttcatggagatgtcattaaggatttttgtcatcaagttaattagttccttcacaatgcaaagtatatataatcaatttaattcctcaaccatgtcaaacaaagaatcctcaaccgtgtaaaatgtcatcaaattttttaagattgcatcacactcattttttgcgttatgatagaaagacaaattttataacacgttagataaccgtaagtgagacaaagagagtaaattgattattttttttaaatgaattgaagtgatgggcatttttttttaaagtagaaatcggagttttttcaatttattttttctccttttgctttataactattatgcttcacacacagtgttctgaacattcagtacaaaaataccaacaaccggatttatttaaacattgtattatttgcatggtgtgtacggttgacatatagttatattcatattccttatgtatgtgatcaaatacttaattgaattctcggttttgtgtctataaaaaaaaattgaaatcaaccctttaaatagatctttatattataaaagattatttttcattcttggttggaagatacttgaactcttgtgtttatctttgtagctaattttactattctcacttagcttttatgtaacagtattggtagcagtaagcagtagcttctttttctgtcaaatgaattagttgttccaggtctagtgagggctcagataccatttttttttttttgaataactgataccaatttgttagaaatgtatgatcagaagtcagaactacagatttgggaatgccttattcgtttattgatagtctggtatcgctatataatggtctgacaagataataacagaatataaaaagaaaaaaagaaaacggaagataagaaacatctacaactagaaatacggaaacagatcttaaacaacaattgcactatcctagataacagggctcttttttaacacagataaatcttaaacagaaaatcctaaaccttttttgcttatatttttatcagcaattttttttaaaaactagaatatggggtttactactatgttgcttaaacttataaatgcttaatcaaatatataatatttaggtacaaaaattctgagtgtgtacgtacgtagcaggtccctctgtctaattgtcgtaggctccactattttttttttgtcgaaagcttagattttttttaaaaaaaaataatgtagcataattaattgaggatatgggaccattccctctctaccaggtttgtgtcgcacaaagcaaggcgatattgctttcagcgaaagagttacatagaaaaaaaataaaatccgttaagtacattttaggataagtcaatttgttctcaacattttccagagatattttgggctttggtggtggtgttattttgatttctctggagtgacagaaacttagctgagcattgaataagactcagtaccttatagcttctttttgctgttgaatcttagcaaaaaaaaaaatggcatgcaatcacaaggttcaatcattaggagaagaaagtgaataccccaactgaatagattcctccttaactatgacatgttcgataatttaatgcatagatgcactttgtaatttacccacatttataaacccccgcccccaccgtaaaaaaatgttggaaatcttatgcaacaacccaaaaaaccataaatggtacccctacttgcaatatcccttcatgctcgacactgggatagcattgacttgtcttcaccttaatgaaagatggttagtaaaaaagttgtttcatttgaggatattttgcaaagagttgtttaaaaagaaaatattcaaagcaaatttacaaaacatgaaagtcacctttcacatcttaactattaccaagtggaccccaaccctcttagtcaatttaagaccatcatttctttaaaaaaaaagacacacatatatattatcccttatgatatagttccattcaaccttgatcattaacactaaagcaaaatgattcaatgaccaataaaatttacaggaaactgaataaatgaatccgattacttcttttccccttctctatcatacatattctcgtaaaataagagttctatgttacaaatcaaaattgtggtggagttgcaaagaccacatctagtttcacttagacattctcattctcaattagaaagagcagctcagctctcagcaaaaaaaggaaaagaagttgcacaagcttgtacctctcccctccccctccctctccacaacctgtacaaattctctgtagtctaaatgaattactatgatgcacaaggtgagaactgagaactgcacccccaatctggcagcaccaagcatgcaacttgtgacagatgttccccttccaatcagtaagaaaatcaagacaatcagtcgacacgagtcaccatccaaatagtttttaagatagcaaccaatcaatcactcgctactcgctgtcagtgtgcaagtaacaaaagaatgcatcaagaaatttggaatcattttctggcccatgatgccgttcttcccgcacagtgtcaaaggagggttccttgtgcacacataattgagattcaagtatcgtgttacaattaaataatcaatcagtacggaatgacgtatggaagagcaaaaacatctgcgggctctatgcgcagagcttctgcccatacctgaggtgtctccccaacctctattgaagatttcaccacagattttctttcttgtgaaacattggtgtcaaatagccactcttgatcatcaaaatcagaccactgctccaccttaggtactgaatatacctggcctaagtacttggtatctggatggggtggctttgcagatgcttcagttaccaaagtagctggcacagtggcagtgggagtcttgattgaagaagctgcaaatggcttactttcaatgatcccatttatcttgctttctttcttttctaccttaacactggtggcttctcgtggcctatctgaagcatttggaatggatacttggcaaggttcccatacccttccattttcattgaatggatgagaggaagacaattttggaaacttattgggcaaactgtcattgactgtaacaaatttttttaaaaaaagttataacctgtcagtcaacagcaaaataatgtgtacaaacttgcgaaaacttgtcaacatgactgaaaaaataccaataattgaaatatcaaatataagcatgtgacatcagggaaaacccaccattatctcacaggacgtagtatctggtattagcttattaggtcagcaatatactagtccaaatccaataagagaaacatcttattcttttttaaatacaacttaacaggatcactgagtagaaatgagaacaagactcatcataagtaacactcaccatgtggaactccatttgactcaatgtccttccgcttcttacgattttctccactgacagtgttcccatggctgttcctagaaggctgtgcgaaagaatttgaatttataagtccaactttgttgctttcttttaatttattttgctctgttgttttaagttcaccatgctccttagctttctcctcctttttcttctctttatccctgtctttgtccttcccatgccctttcttctccttctctttatctttccttttatctcttcgtttatcatcttttttctccttaaccttttcctttccttcatctttcttttccttaaccttcctttcttctgtcttttccttggccttttctttttcatctttcttttccttaaccttttctttaccttcaactgttgcttccaaattcctttcaaaatactttcccaatagtttgggtattccatcaactctaggatgaaaatttccaacatgattctgaactggtgctgcatttccaattggccggacctcatcctgtattcctcgcccatcaatcttcttaacatcaagacccatatccttgagtttttcattaccatcagacctggtgccaccacctttagccaccaacctaacagtcccctcatcttttctatggtttgtatttgtaaatttatgaaccaattgatggttagctcctccatcatcatccttaatcctccgatccaactccaggaggaactttgaatccttgttctcttcagccagatgatttttctctctagccttctccccattgttgccagcatactgtttggtgagtctgttctcaaacaagatacccttcttattgtcttgcttaatttccttttgatggggtttacctgcgttgagaccctcagcttgtcttgggaaccctttgtcatctgcagtactgcttttacttttatctctatctttgctcttgtccttgtctttatccttatctttctttttctctctgtgtttttcctttttgtccttcttttccttatgcttcccatctcttccttctttctctctcttttccttgctttccctcttctctttgtccttcttatctttcttatgttttttttctttctgcttttcctgcaagtcatatggtgagaagagatgttaagaacaacaatcaaataaggaatcaaccaaaatggcttcacaacctcatcacccaagagcaatcaaagaaaaaaaaagaatatcaatagtaaaacacgcacacacaaaaaaggttcatgtctccttgacaatcatatatctccaaggaaaaagccacaacaataacaacaggatcaaagttcttcaatacacattgtctaccgacaaagtattctaaattctaggagagcacattacagccaactataaccaaactaagagggaaagcacaattccattgaagtcaaaataaaagtatagcaatgcactttgatgccttattaaacattcccaatgattagattctttaaacccaacagaaacaatttcattcttagaggctactgtcggccattctgatccatattctctttcttttttggcttttgaaacatattagaaataagatatgctacaacacttttaacggaagttcggtattctatgcctgatattgaaataaaaagatcagagaagtgcaaatgacatgtcttattaaggactaaaaataaaaaaactccagaaaataaaatatacatgtccagttataagttataacccatagatgaacgaccaggaaacttcaatgataccaaggaaaatacccatctatgttccaatagttgaatcaaaatgaatgcaaaattgaacaaaccttgatcattttattcctcaaaaaaattaaggcatagaacaaacaacaaagccactgcttttcatcttctaagtcacaagaagtagtccaatacaccgtaacaaaagtcgtaactatactgagctccattaggatactccttgtagaggagcatcctaagtaaaacagatgagactctaggatcttcatctagtgtgaaattatccccatttagtttttgaaccgccatgacaatgcagtgtgatgaaatgtttaaataaacagactggattgatcacttgaactggtctggccatgaaccagctatgtctctaattcaaacactttcaagaccttattgctatgattttatacttagataactaagatttttattatctatggttataaatgcctttagttgacttacattattttgaccttatgcatcattgtaatatacacacttccttcctgtcataaaacatatgaaattctagttagaaatactctgatgactcccccctaaagagagaaagtaagagtgtgtctacccttgatttgaaatggataaagtttacaagatgatttaattcaaatcaagagtgaatacaagctaattttctcactttacacctcactttaaaggagttaaaccccagtttatcattctacagagtatcaagggttattacgcttattaatctacatcaggtctcactggctcaatttccaatttgattttaaaaacattgacacgattcaagaatatgctctacaagccaactcctacatggaggatttgatgaacttatggttagaaacgaactgctaatgttaaaaaataattatattataatgcttagtaaaaggaaagactaaataaaactattgaaatgtaatcatttaaataaggaatgggttgcaactgaatgcagtcatcacctcccacatgcagaatgtttaaaacttcattttttgtatccatttgacaatcaattttatcaccaaaacttcttatataagcattaaaatgatattgaaacaggatctaaacaaaatgggaacaaagcatagcagttttggtctttgtaaatgaggagaaacttgcaattatacaaatattagaacctgattaggaaaatatttgcacagagtgaaacacttcaacctccattctatttcaaaatccatacaaatgtcccccacaatgtacaaataccaacttcaaaactgcccacattatcttccctggattttcctcactttctttcacaaacttcctctatacaatgatgatcattgaggtttcgataacagaaggaagaaattacaaaaattagaaggaaaaaaaggaccaattgaaggactctactcttgaaaaaattatcaaaccaaaaggctaaagtaattattatcatgcaatacattggtcatgcaattcaaattatgtagttcaagtcggttcctataatgcaataccttaaaggcttaatcatatacttaaaactcccatcaactaaaaatataagcaaacaccctgatccacagaagtaaatctactgcataacgtactccctttaatgaatcaaccaatgcaataatctagctgatctacataacttcaacctccatactcaaacatcctcatccaacaaacagatgctgctttattattttctcttcctcctcaaaattttcaaattccttcttataggaaagctcagctacctataagagattctactgctaacagaatccaattaaaagttgaagcaaagaaatggtataatagaaagaaacaaataaaaaatcatcagaagagatattgccactagccaatctctccagatagtcagataccagtgggttggtggaagtccagtccagcaaggaaaagagaggcattgtgggggaacaggagataaagtgtggaccaaagagtcagagtcactacccatgaagaggcccagaggtcactgctgaactcagagaagcatcacagacaaaaaaaaagggggaccaggggagaaggggggctcacatcaatacacaatcagaaattttagggcacccattgcatctttatatagtaccacttcatgaaacttgcaatacaatagtagagaagaagtatcttgagagcaccataggtgactaactatggtcctgaattgaaaagacaggataatcaataatgttttgatatggtaaaaacgcacaccatatcaaccaaaaagaaaagctacactaacaattttcaatgtcacctaacaagaagaatgatagatttacacttaaaattaagggaatgagttgactagcatcattgtcagtcaaattaagaatttaacgcagatacttgactaaatattaatcagttcattcctttcaatataaaatcaacccgaagtaattaatttgcatccataacttatatgatgatttcattagcaaatcatagttggccctgaaaatatataacttattagtctaatcaagataaacataacacaaactcaagggacaaataaattgctgtaaccaaaagaatctatacaagaacaaaatacaaaatttccaaccttgatcacctcatcatagcaacctctagacaaaataaactcaaaaaattcatgtttgattcaagaagtcatagtagccaactaaccggagattaaacatttagtattagtatattttacatatatcaaaccctcagaatttcctataggatcatctaagaagaatacaacaacaaaagccttttcccaatagttggaatctgctacacgaatcaaaccatgccattgtactacatcaaaaacccagcttttgccaaggctatttttagatcatggtattttgtaatggttttactgaaattttccttggtaatcacaacaaaatatgttcaggtagaaaagacaaaataagaaactgaaaaagtcaaaattatttatacaaaatcataaacccaactatttacaatcaaatcagtgtgaattcttggtcttcatcttctcagtcgagtcagtcccacttgtgtaaaaatcaattggttgggcccaagaatatctagaaccaatttttgccagtgtaattaacttactctatgcatctgattagcctcccattgagaatacacaaataatatatctaaccatggactgtccttattcttcacagctattatttcaacaaagacatagaactaacaatttgcctcaacgtgcaagagcagatcattacaacttgcttaagtcaatttgaaccccaaaaatgattataattctacgaccttactctaaattcattttagatgaagtgaaatgctttgttctatgactgacaagatcaaggatatttaaagatgctgctttaaaaaaatcagcaagtattacaaagaatattagaagaatctccaaaaccaaaatataaatgaacaatctctactgatactaactttttgcttcaatacctaaggtgccaaggcacaccatcaagcccaaagttcatcattttacaacaaaaggactcataacttgattactcatgattacttattcaatattaatcataggctaatgttttgaagatcccatactcctacaaaacaagcaaaacaatccataacaaaatcatatattatgtgaaaccgattgcactggtatgtgtttactttgacaggcatgccaaaataatacagaaatgtaaatgataactccacttctaagttctaacatgaaagtacaaatcaaattcacttcaaaaactaaaatcctatgacctgctgtcaaaacaatgtataaaattgttaacaacaggcataaaacaagtggagcatacacacttttaatcatcataatatcctttcctcttcaccagtaatgacataattttctccaatcaatcctcttgaaacttatatattttcaggagtacaggagtacataccataacagtccaaaaatcaaaattttggacacagcacagaaaacctaacatcttgtaaacaaataagacagataaagtagagtaaatcacgtgaaccaacttccatcaacaaaatgcacaacccctactaataactgtaggccataccagatactgtaatgtaactatgtaagcctccaatcatctttgcactcataccgaagaagatctgttatactttcatggcttatgtgatcgttcaaaagaggccaattaaaatgtttctagcaagaattttacaatgaactccaaacaaattgaatttatattattaagaagaaacaaatgaaaaattaaggagtagaaaattaattcgaacatgaatgcattcagcacttgctctagagaaacattttaatgttccattcagaaaataaagtctatcaatatacatttaacgttatgcgattcacaaaaaactccattttgcatcacaattaaatgcatgtcaaattatatgtacaatgtgagtgtaggaaaagtatattaaccttttctaataagtccacttcatctgttatagccttctttccatatcctggtggtggaaatggaaaacaacgcgacattgcacaaaatccaaatacgcctagtgtaaaattcttctaaatttgagagtgcttgaattagtttccagtagccctgttccagaaagggaacgaaccagcaactatgctcctgtccatgcaccatgtcaccgcattcatttccagctttaatattcctccataagcctcttactacaaacacaaattgtggaaaccaccaaggtttactaccctcaccaaaatattcaaacagctcaaactatactactaaaaattgattcaaaatcaacgcacagcacagcaaccacttgttttctaactacttaaagtcggcaaatggttcaacacaattccaatcagtacatgtttcctacactagtgttaagctcaggctaactatatcaattcaaagggctgcttcagaaaccaaaaaggaccactgaaatcagatactctagtttccttgtgaacccactaagaatcaacagctttttctttgtgtcaaatccctaaaccaaaatgatcccccagcaaagacaaaaaacaaaaacaccaaaaatgaagacccagaaggctttatagtgtgcccaagaacggttctccaaatcctgatcaccgattccctgttattaatatagacaatcttcttccatgctcaaagaagcaatattaaacaccatcttaagcaatctgcaagtgcgaatgctcaaccaccgtagctctaaatccacaatatgaacccctgaaaagatcagagcccatgcccattttacgcaacccccacggagagaatgaacaagcacagtcttcctttcaatcacaccctccgatcaaaaccctaatcactcgggaattttccaatttggacaagtgccccccagttacgatccaatgaaaccctaaaaaaacacacaaacaagctgagtacacatacccgaaaaaatacccacaaggaatgaaaaccctaatcctaattccgaaaattttgttgattaaacacccaaaaaaaaggagcataaagcagcaaaattgaaggggaataaagagaatcaagcacttttttgaaacctaagcaataatgggcatcgatcaaaaggggaaaaagaagctctgattcgaagcgttaacgggacaggaaaaaaatagtgaaatatcggtcgatgaagaagagtccaagtgaaatttgttgcataagattacctagtccgctacaaagtgaccattgtaggaggacaagaatcacaagatctctctctctctctctctttcacatgaataaatagaagaaagagagaacaacaatctcaatatacacaaaactatgtatatctatatgtacatataatatataatatatgattttgggggaagtacttttttctttgtgtgttctgtgttgttgttgttgctatggtatgctattcacaaagcaagagccgttattagtctctagattctgggttttgttgtttctctttgtttaccactctgcttcttttcttttcttttcttctgttctctctctttctctatcaggttatgggtatatgtttgcgtttctgtgcttgtgtgttgtccgtaaatatatatatatctcatcattattgttagtgttattggtcatgtgtttctttttctttattttttttctcactttctatgctctttctctctattcctaagggggctgatgtgctgtttttgcgttcggaagttacacgcgaggatgaaaaataattgaaaacccaaatgccgaaaccaaaccagaacaaaaaggaagggcaacaatggaatgccaagcaaagccacatgtccattgtccatcacactcgatgtatatgtactagtgtaatttaacatgtcaagtaccaacataatatgtggtcaaggatttcaatctcaagtctatttatatgaaaaaatatttcttttcatatgaatattttgtgtaaccactagacattttagtttgagatatttttataagttttgatcttttaagttgattataaaataaattatcaatccatttaaacacacttaaattattgtttcttttcaatatatgttatataggaatcatatttaaatcatcttttacaaactcaacataaattattaacttaattacattcattgattcttatatgaatattttaataaacatttgttataagatttttttttttaagaagttgaagttgaagatgttaatttcttgtgtttggtttatcatttaaaaataatatttttcagtaaacattgtttttcaataatgtttttacatagtttttttataaaattattttcatgggaaagataaacatataagtttctcaagctaaaaaataattattgtgattaaaaaatttatcatgatactcttattatatcatttaatttaatatgataaataattaaaatttaagggaaagttctattaaatattaacatacaaatattttattcttaatatatatatatattctcaatcaaacatatttttattagagattaatccctaactctcaagtgagttaccttccattaaaaaaatgtcaatataatttttcatttatctacttagtttataaattgagtttaatgtttatacattaatggtataaaatatttttatattatcatttaattataaattattgtttgaattattttaagataattatttaaaaaaaaaattagcatgtataatagattgtgatggaatgattgcgttttttacacggctaatgcatgattttttttttctcttataaatttgttagactaaaatttatgattatgttgttatgtttggataaaagttgaaaacatggtttgatgattctaatgcacattttttaagttcaggtggcgaaataaggaaagaagaaaatgtcgttttggaaatcaaagtattttttagttccttcaattgatattcaaacatggactataactataatttatttatattttattgaaagtggattttgtttcgaggatttgttaatttgatttgtattccgatttaaaatctctatttatttcctttaaatttgaaatgataatacatgaacttatagtcagtttcttttcatagttctggtaagctagcaacattcagtttttagttgacagtgtgtacaagtcaaaatattatttttcttattcacttaagaccatgatttttttatataagaataaaaaacatgtactgaatttattacaacttaagcatcatacttaattaattagcaaacaaaaatgaataaccaactttgatttggttattggacaattaattttaataaataaaaacaattttgggtgatttcaataagtataaatttttacaagcaaaacatttattgaattcattctgctaaagaaatccaatttgagatcaacttggtcaatttgacaaatgtaatagacaatatgtaaaaaatttccaagttaaaagaattggaatgactaatatgagtgaataagataaatatggaaagcaaattaaccaaaagaaattaattgtaatatgaaatttcataaatgcagagtaaatgtagcaaattaagggtgtgtttggtttgtattttcattttctgtttttattttttgaaaactatttttattttcaaaaaattataattctgaaaacatgtttggtttgattttttgttttctattttcaatactgaatatttatgataggttaacttattatcttttttatttttaaatttatttaaaattatatttattgtcatcgcatttttattttattcaaaatgagatttttgttttgaattgaaaacactaaaaatgaaattttattattttcattttttacttgtttcctattttcatttttattaaaaatatttttaaaaattcaatcaaacatatttttatcatcattttcaattttcactgaaaataaaaacaaaaaatagtcaaaccaaacaccccacaagaatagaaagggaaaaggagacaaatatcaagtgaattgaaatttaaagaaaagtagataaactgaaagctctattaaaacattaattgtcttgaaacactaaaatgtcttttagttttacaggcatttacctcacacctcaccgtacacatctaccaaagagaagcatcaacgttcgggaaggagtttggcttggaattaaaacatgaatgatcaactatgaaatatgggataagttcgttggtttgccttgatttgaaccacaaattttttaagtataatagtaattgattttttaaattttaaaatattattatatatgtcatgtataataataataatttaatataaatgaatagatgaacatgtttaaataaattgagtcggatttgacaaaaatataaaaaattgatagtactaatcatgaacacttctaaatacaatgacaaattcacaagatgtaaaaagagaatacaacatgagaaagtagaggaatcctacgatttagcattacatacttgttgatgcattttattcctttccaccatttctaaattcaaaacaattttggtccatttgggtgtgtatgaataaaaggttctacgggacactaaatgaacaacattttattaaatattttcaatacttttcatataactaactaacaagtatctagtacatggtatatatgtgctgataaaatggcatggatatgcgtatatatgtaaattttcaaaaatataaattaaataagtttattcaataaaaaatattttctcaacaatgaaatacaagtatttaaaacttttattttaaataataacttaattaataaagtaacattttaaaaataattgtgaataccacattgtacttatgtttataaaaaaagtattccatagtttgttttgccccggattttttcttttttaaatcaaacataacacaataacttttttgttatttaatattataatttttaacaaattaaatagatcctatatattctacaaaagaagaatttttcttaacttcttgcacatccacccacttatttacatggttttttcccataatatgttttcttctcatttgtgtaacttttctatccatttttttctcaatcttttaaactttttcctagtcatttagttacatgacttttcttcctgttttacttaaccatctgaattatctttttcttatttttccttgtctatttacatagttttcacttgtataaacatattatttaatgtgtgcatgtgtttgtgtagatacagagagaggacatttatttaatgttatttgtaattttttaaacatattttcaatgttcatttttattgattcattaatttctatacataaaatttatgtaagtttagtattatttttcagtgttatttttatgagaaactcttacatagacacaaactcaacacattatttttaggcacattcaataagaattttacaattaataaaataaaacaaataaaaaatcagaatatcaagtaaaattaaattttgataatctttatttttttgctaaacttcattgaaattgaaatacataaaaggattataatttgaatttagaaaatataatttaaatttcaaaaataatgtattttggtagtgtaaaattgtagagtattctatttttaaataataaatttaataatacaaatgaaacacgttgatttattcagtttatacaatatatcaaaattttaaaattaaaatcaaacgattgctataattaataatatttaaaaagaagaattataaagtaagttaaacttaagaaaaaaaatcctcaatctgaagtagcataatatttaaggtgtagtttgttttagtttttaactttttgtttataagtttttcttcttaaaaattattaattaattataattatacttgaaatacaatagttaattttggtttaactatcttatataaattatttaaaagtttagtttaactttttacaagtctaatataagttatcttatataaatttgagaccacattcattattttatataaattaatttgaattttcttaaaaacataattaaaatctcactttttagtaatattaacaaataaaattgtgaacttacttataaataagttaattaatatacttatgtaaatttaaactttaataaattaataaacatataatttcaaaagatcataataaaattcaatataataatacattatgtacattatttaagaaatcttgtataatctttgacacattatttataacacatgtagtattaaaccccaaatctaagagagttattaaatgagaaataggatcattaaaatttatgacttctaataaattttaactaataataaatattgtgtttaaaacaatatgctaaaaatgcacctctataatttctagtttatttaaatgagtaaacttattaagattaacctttttggtatctttggataagataagcaactttgaaagagagaaaaaaaaaaaaaaacagccgtatatcaaattatctagtttgcatattaaattcaaaaaagttttaaaaagataagatttttatcggaaatattttgaaattcaaaaagaaagattaattgatctataacatgaatagatgagttccaagcgtgcctttggcttcaatgtttcaaagaaaccagcgtcatggcttaaaaaaagaaagagaaccctgttgacttaagagtcagctttcaactctgaaagcgatcaaagaaaaaaaaatgtttgggttttctcagcaacataacaatgttgataataatggtgggaccagcagtttgagtgatgatgaggatgatttgactcggttctttgattatgacactgcgccggggcagaatctagatgagctattcgcgccgagcattgtcactcagcttcctcccatgttgccggcggaggccacccaacaccaccatacattgcctcagcacgtgaatcagattgtgtcgtcgtctccggtcgatttgcccagccacgtcccaattgaggcactggtgcagcagaatggtggttcatcggttcagcgtcagagaggaaaagggttgcaatggactgtagaagaacacatgtacactttcattattgctgcaatttttctgattggattgaacttgttttaaagagataaattatttaatctaatcactttaatttttttagtttatcgtctattctgttttttttattgggatcagtttttggttttagtctcaaggaaccgtttctttcacgaactatttctttaatcttaaaaatacagtgttttctataacctcgaattggatctgaagtgttctcagcatttaagaatacaaatattaagtcaatttggatctttagtttttcactattttactttttctttacatgctctgacttgagggcattcattgtttcgctgtcaatttgttgttgcttttcaactaattaccgtgaaatgtttcagataagacacgcacaaaacaatttttggttcccaataaacacagtatatagagaaaagaccaagatccattgtgaaaaattgcgttgtattatttaatatattttaagatgttgttttaatttttcttccgaatcttttattgaactgaaatgaagtctgaaaaatttattaaattttcatctcatatttgttttttcatgacaggaaatttttagttgcacttgacgaagttggcaagggagactggataaccatctcaaaacatattggaacaaaatcttctactcaagttgctagtcatgctcaaaaatactaccttcgccaaaaagccaaaaagaaaataagaaaaagcattcatgacattactttaaatacaatttctcaccaggatgacacacaaaattcaactcctcatccagatcctgaaattcaaccagttcatgaaattcaccaaatgcaagaaatgccaccaaacagcatgactcatcaaatgagtggattcgaatattttgccaatcaacaagtccatgaaatacaacaaatgcaagacatattgtcggtgtatccatcaaacaacataactcatcaaatgggtggatttgaacattttgtcaatcaacaagttcatgaaatgccggtgtatccaccaaacaacatgactcatcaaatgagtggatttgaacattttgcgaatcaacaagtccatgaaatgcaacaaatgcaagacatattgtcgatgtatccatcaaacaacatgattcatcaaatgaatggatctgaatattttgtcaatcaacaagtccatgaaatgccggtgcatccaccaaacaacatgactcatcaaatgagtggatttcaatatcttgctaatcaacaagtccataaaatacaacaaatgcaagacatattgccggcgtatccatcaaataacatgactcaccaaatgagcggatttgaatgttctaataaagactttggaagaggttgctacaagccggagtatccaccaaacaacactagttcatccaacaattaaattgctttacgtttaggtgttaatgcactactttcatccattttgtttttggaaattccaccaaattatttttgtttactccccgcatagattttggtctctggtctgttttaaggtgtaggagtcgatttttttttctttctcgagatatgatgtgtgctttgagcatgtgtcttgaacaattgagatagagtaggattttttatttgtgacttattgattacctttccttgaaggacttttaatatcttttaattttatttagtttataaagtaattaggagttttgataatttcattgttgttggtgcaaattatatttgtattcatttgtgcttttaggatgtgaggtgtgaataagtataatttatctttatattcatttttatagttgctattacaacttgagctccttctaactcagtaagtcatattattgctgtatggttaatgaaaatgtgtctgcattttacaaaaaataaataatctgtttcttttatctcttagtttccaatttgatccagttttaaaattcaataactcagtcaggtgggatcgatgctatttagtagttagtaccatatcttagtctttcattcgatattaatttagatgctgatgcattattagatataatatttcttcacacagcttgttttaccattctatttttggaatttcatcaagatatgattctttagagacagtagagattgtgggttgttttaagggttagagtcatgtttttttgaggccatgacgtataatttgagttgagtattcaagtgaacggttatttctcttgtttttagaatcagcatttccaactggaataagcattaaaagtggtgagatctcatgcctgtccttaaaaggattatgttgtacagcaacgatttggatttgtccacttctatcatgtgaggcccacaagtacaacacaagaaagggacaataggagagaaaggaatgtgagaaatgcaagaatgaagatgttaaagatgcacgtggctacacaaaaaaggatacaatctgaaatgattatacatgcaacaaggtaggataataaaaaatcggttaagtggtttggacacttccaaagaagccacaagaagcacggttaagggagagttaaaatgaagtcgtcaaggagatctatgataaacaatatttctaaaactttaatttttaatccatccgaatgagtcgtcgtactgtctgtgtgattaaggtaacccctaaaccttaagtacaacgatcaatgtatggctcctcactcagtttgagtacacggatcaaaagttctctctatgatttttttgccagattttgtgctcaatcatctggcataatattttgataatccctccctccatgaacggatcttgttttttcactaattatctcccggttatctttgaaatgttcaccgtaacaccaccatgtttatctaatataggaagcaataagcctatatatttagctttacggtaaaaataaattcagctacaatgtataaaggatgaagaaaggaaagggataaaagacatggatttattatttttagacttttgatctctatcactctgatgagagagtgtaatgttttatcttacgcatgcgcaacttttcttttatctctgtcacttttacaggagtggttgctaatatgtgttttacaagagtgaatttcgtaatggattgtaaatcagtgaatgaagcatggtcttactcacacaaagcatgaaacatggtcttacttacataccaaagaataaaaagctattttcatgacattatgtggtcttactcacacaaagcatacctagcttgtcttacacacacaaagcatacctacaattattgagctaaattaacatttcatgacattattgtagtccactgtaacaaactcgccgcaatagcgagaaatttgtagtgctagttaagtgtcacttttcatgacatggattggatatagagttttcttgtcaattactttctttttttttgactttgatgtacaggtcttgaccaacctttagtaataatagtatcattcgtaattaaaaaaagaagaagtaaacttctattttttataataaaaaggactaaatatattttaggttgttataagttagaattaatttttaaactttgcacttagtttctaataaaaaaattcttgacttttggttctgaaattatattacattttgtacaaagaaaattctaagtcaagggggactaagttaattgtcacaagtgacaactctccttacacaattaagccataaacctggtttcagacagttctatagtccaatttataatcaaacacaaatgaaattggataaaagctattcactttgcaattgtatagatcaataatgtgtaagcttaattgcatttataacatgacatatttttatttactagaatacataaagaaccatgtgaggaaggcagggaaaaaggcaaaatagagtacactttaatttcaacctgaataggtaagaataaataagaaaaataaaaaggatttgtggttttgcacaatatatatatatatatatatatatatatatatatatatatatatatatatatggattcaacaaggctatcaatcaacagtcaacatagtcatgcagtgtacaatatagttgagagaaaacacagaacacagccaattcgttagaggaaacatgctcatcatctactcagtactcacctacccacttcaagttcaactgtctatctattcatatatatatacccacccttccaaaccactttgcaacatccatccaagccttttctttcctagctactacactttcattctttgcttcagaaaattaactagctaggatggtcagtgttgaagagatccgtaatgcacaacgtgcagagggccctgccactgtcatggctattggcaccgcaactcctccaaactgtgtcgatcagagtacctatcctgactattatttccgcatcaccaacagcgagcacatgaccgagctcaaagaaaaattcaagcgcatgtgtaagatatatatctctctcctttcttcatttctttatacaatatgtatattgcttattttcaacatattcctttgatttgattagtgatattaatgaaatttaatttattatttcgatcaggtgataagtcgatgattaagaagcgatacatgtacttaaatgaagaaatcctgaaagagaatccgagtgtttgtgcttacatggcaccttcgttggatgcaaggcaagacatggtggttgtggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgcccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacattccgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaagttggtctcactttccatctcctcaaggatgttcctggactcatctccaagaatattgagaaggccttggttgaagccttccaacccttgggaatctccgattacaattctatcttctggattgcacaccctggtggacccgcaattttggaccaagttgaggctaagttaggcttgaagcctgaaaaaatggaagctactagacatgtgctcagcgagtatggtaacatgtcaagtgcatgtgtgctattcatcttggatcaaatgaggaagaaatcaatagaaaatggacttggcacaaccggtgaaggccttgactggggtgtgctatttggtttcggccctggactcaccgttgagactgttgtgctccgcagtgtcactgtctaatccatatatcttgtgcaagaccaagtccttttctttcttattcattccttcatgttgagtttgaaaaatgtattctttctcttcctttttttccctgcttccctcacatgcttctttttttatatcagtaaataagaacatgttatattactattaatgcaattaagttttcacaaaattcatctatatattcagttgcaaagtgaatatctcttgtccaatttcatctttattgaaagattctttgtgacttgctataaaagtgactgtagaactttgcaggtttatggcttaattgtgtaaagagaatagtgccaattaacgtagtccacttaggcttaatttttttttttttttttttgtgttgattgagttatctaactgtgagtctgtgagaaaaacattataaaaaagggattaataagtatcaagtaaacctagtaggtaagaaattgcacttcctaccttgattacttaatgaacaaaatctaagtcgacaaagtggttggactgctcttcgcattatttgccttacaagagttaactacttaaccacaatagataacatttatccatgacttcgtattaacactttaaaataaatgttccataccacctatgaggtgtagtatgggctctaaggttagaatttatgtttcagttggtatcatgctgcagcttatggtgtgcatcaatatgtgaaatctattactcaatttgtttcagtttgtattacattttcattgtgtgcttttgatttaatatatgaaatatcataacgcagtttatcactttaggtagtttttatcatattccagtttatcttgtgcttctggttgagtatcagattgcagtttttatcagattgtagtttatggtgtgcttctgattcaatatgtaaaatttgtgacacaatttgtttcagtttttatcttattgtaatttatgatttggttctatctgtgtatcatttaggttttgttgttcgggtgatggtgtgctgtgaaatttatcacaatctcatggggtgccaatttggctctgctgctctggccattgtataccaatatgattctaatcatggtatgttagtttgtttctggttatggtgtgtcaatttttttttacgtctgtaccaatttgattctgttttaggggccttggtttattgtgaaatctgtcacaatttagggacatttgttagtttgtttcagtcatggagttttgtgatgtattaataccaaccaatttacttatgtaatgagcattttaaaaccgaatgaccatttaaaaccttgcacataaaagcataattttgattgataaactacttgcaggtgannnnnnnnnnnnnnnnnnnnnnnnnnnnnnnnnnnnnnnnnnnnnnnnnnnnnnnnnnnnnnnnnnnnnnnnnnnnntgcaagtagtctatcacaaattgagtaatagatttcacatattgatgcacaccataagctgcagcatgataccaactgaaacataaattctaaccttagagcccatactacacctcataggtggtatggaacatttattttaaagtgttaatacgaagtcatggataaatgttatctattgtggttaagtagttaactcttgtaaggcaaataatgcgaagagcagtccaaccactttgtcgacttagattttgttcattaagtaatcaaggtaggaagtgcaatttcttacctactaggtttacttgatacttattaatcccttttttataatgtttttctcacagactcacagttagataactcaatcaacacaaaaaaaaaaaaaaaaaaattaagcctaagtggactacgttaattggcactattctctttacacaattaagccataaacctgcaaagttctacagtcacttttatagcaagtcacaaagaatctttcaataaagatgaaattggacaagagatattcactttgcaactgaatatatagatgaattttgtgaaaacttaattgcattaatagtaatataacatgttcttatttactgatataaaaaaagaagcatgtgagggaagcagggaaaaaaaggaagagaaagaatacatttttcaaactcaacatgaaagaatgaataagaaagaaaaggacttggtcttgcacaagatatatggattagacagtgacactgcggagcacaacagtctcaacggtgagtccagggccgaaaccaaatagcacaccccagtcaaggccttcaccggttgtgccaagtccattttctattgatttcttcctcatttgatccaagatgaatagcacacatgcacttgacatgttaccatactcgctgagcacatgtctagtagcttccattttttcaggcttcaagcctaacttagcctcaacttggtccaaaattgcgggtccaccagggtgtgcaatccagaagatagaattgtaatcggagattcccaagggttggaaggcttcaaccaaggccttctcaatattcttggagatgagtccaggaacatccttgaggagatggaaagtgagaccaacttcgcgaaggtgtccatcaatagccccttcactgtctggaaggattgtctgggcagtccagacaagctgaaacaaaggcttttcaactggtaaggggtctgatccaacaatgacagcggctgcaccatctccaaacaaggcttgacccacaaggctatcaagatgggtgtcagttgggccgcggaatgtgactgcggtgatctcagaacaaacgacaagcacgcgagcacccttgttgttttcagcgaggtctttggccaaacgaagcaccgtgccaccggcaaagcagccttgttggtacatcatgtaacgcttgacggagggacgaaggcctaatagtttagtgagctgataatcagcaccaggcatgtcgacaccactagtggtgcaaaagatgagatgggtaatcttggacttgggttgaccccattccttgattgccttagttgcagcctcttttcccaactttggtacctccataaccaccatgtcttgccttgcatccaacgaaggtgccatatatgcacaaacactgggattctccttcaggatctcttcgtttaagtacatgtatcgcttcttaatcatcgacttatcacctgaaataataaattaaatttcattgatatcattaatgaaatcaaaggtatatgttggaaataagcaacatgcatattatataatgaaatgaagataggataaaagagagagatatcttacacatgcgtttgaatttttctttgagctcggtcatgtgctcgctgttggtgatgcggaaataatagtcaggataggtactctgatccacgcagttgggaggagtggcggtgccaatagccatgacagtggcagggccttctgcacgttgcgccttacgaatctcttcaacactcaccatcctagctagttaattttctggagcaaaggatgaaagtgaagtagtagctatctacgaaagaaaaggcttggatggatgttgcaaagtggcttggaagggtggatatatatatatagaaaagtgtgggtaggtagattaaggtagatgcagtgcatgcttcctttctctgactgcgcttgtggtgtgcacccaccgcatgtctaagtagaccgctgattctccccattatagttatacttaccaacccatttttttttcttttcctaatgatcagcaaataaccgggttttaattttctgtttttttttctttagttgagttatgtttatgaaaaaaaaaatgtcacgaggaaattatttgtttttaataccaagtctgattgattgatttgtctcatttatcatcttgaaaacattccaataaaaaataaatgttttaaataaaactgtttttaaacaagagattcatgatttttttgcaattcagatatcctgtccattatatggatatctatttttttcacctccatggtgcttaaaaatttcaaagactaatattaaattcttttttaaaaaaaattgaaaaacattttttctcttatcttctctctcatgaaagaaactggtcgtggttatgttggtctgaagagaaattattaaatgattatgatttatcttggttcttacactatattaatttttatgtaatatataatcaagtaatcataaattaataatttttaatatgtgttatataaatattagtttgagattatagacatgtgtggctgtgaactacttcataatttatttggtttgggaggggattaaactgaactttatctttggaataagtgggtgatgaagctttacgttagtatgctccaacgaacaacaatctgatcaggaattggggagttggtatagttttattattttatcttaagttaacttgatgcaagtctactttcagaatgaaatatgaacatcaaatgaatcatttttggctctaagttaaaagtaacttatatcccacaacttcttaacaagttcagtcatctaacttctccaaaatcaaaattgaacattaaatatatagtatatttttaatttaattcataattatatcgctttctttcttcaatttgtaagacgcataaataaaaccatcaccaaaatgtttgttttatgattaatttcatgaaataaatatatttgatttgtggaaaattatatagttggctttattataactaattacttttagcttttgtaagttcactgtttttgttattcttttcttttacgagaaggtgcattgcattcaagtatatcatgcgagaaagaagaactaaaacagggtcaatattgactttgacaacaaatggaacttttaagttttaatcttaaaatgactttatctattgatctttgttatttgacttatgctacacgatagttttactttcattttcattaataactagtattacatagtataaatatttattttatataataactaaaatttctgacataaataatcttaatattaaattacattataattaaaattttaataaacaaatattttgggcggcgctttagtatgctccaacgaacaacaatctgatcgggaattgcaaagttggtatagttttattattttatcataatattaaattacattataattaaaatcttaacaaacaaatattttgaatatataaattatatttcagattcataataaataatttaaattgtgatataaggtttatttttaactactgatattttaaagaaatatttaaatttaatttaaaatagagagaaaaaaaacataaagataaaaggagataagattgtttgagatgattaattaagagaaatagtttttagctggttgtgttggtaattttagcacatgtgagtaaataagctttaggaaagagttactcattataaagaaaatattagttagaaagttttttttcttaagtaaaagaccacgagtgtctttaacctagtaggttaaagattaatttcgtttgtggtatgtagttgttcctgattcaagggaattttgcataagatggaaatcaaacacaaattttttcaccaaatagatagtttttactcacgtgaatacaacgaaatcttatattactgcatcaatcctttgaattagtttgaaagtctactaagttatttttctttcttatgagtaggaaaattaaaagaaacaaagataaaaagaggctaatagtcatacaattgtgatatcatattatgatactaatgatcatgtatacatttagaattatgattgcatttttaattttggaattaggggtgagaagaaaattcgtacttgcaaatatttgtgagcaatatttgttatgaaaaaaattaaaatgaatagtttaatagctattcatgagtaaaataaatatatttttatatacttattaatggagtgagggtggataataagaaatccatatcatgattacctataatttaaaattactttaaatgtccttaataatataaaataatttttctgatttatttttagtataaacatatgcttcaaaaattatttatttttaatataaatatatctttttttaaaattattatttttaatataaatatatgtttcaaacctgatgtgatctttactaggagcggattatttgatacatgttacagagttttttagatgacaccacttccaggaagataagtcatggtagactccacaaagattaccttgataagtccaagattggagtagcgaggaactcaaagagaaattttcacaaaatttttttaaatgccaaaagtccttctattgaaaacgaacttcatacatatagagtatctaaatgaaaagatagaaataagcatatgtttttcaaaacagttttgaccaaaattacaacgaaaaaattataaattaaaaaaagaacatatttaacatgggtcttcaaattagtttgggccttcagcaacaattaatattcttaattagtagtgcctttgcatatgggtattcatcattctccacttggatattgttaagtatgtctgttaccatttgttggagggtacccggtgactgtttgatcttacgcctggttatatattcctgtatttagacagttttaggattctcatcaaaatctttttatttctttatttttttttagttttttttttacttaatatgagtatttaatgaaagtacacattgggagtttatctatggtctttatgaatgttggattgcattaattatttcattgtcatgcacaatttgtcatatatcatacttcctttctttttatttataagatccaaatttaaaattatgtttgttttttttataagactcaatttataatgtttattatattaattatttttatactagaaatactcttcattaaaagaaaaaaagaaaacatattattaaaagtacttattgtcttcttactttcatcaagtaataggtagaacttttttatctttatgcttcaagtatgttgttgcacttgtcatgttattttatttttgtacttcgcacacatttgaaggtatgaaagtaggtagaatattttgtcttcttcttctatgggcgaaacttgaaaacttctaaaaatacaattttaccattaaattaaaatggtgtgcccatactcaccttgggtaggagaggaaaaaagagaatgaaatgtgttgaaagaggatgcaataaaagataaaagcgtgaacagcaggattcgaacctgcgcgggcagagcccacatgatttctagtcatgcccgataaccactccggcatgtccacagaattgaaggcaacttttcatattttatatttttacatatacaaatccccccaaaaaaatcatctgaaaaattagctattattctgggaaatacagccggaacattttcagtctctgctttggaattttgcaagggaatcgaatacggtttagatcgttccccacttatgaacacagcgggaatcgttgatgttagctagtttttcgtgacttcattcattccgtagtgaattattgttttgatattttttttctcgagaaaacttcactttccctgaaaatcactccgctctcctctcgctccgaaatccgaaaaggtaagcatgctccatccttcttctttcccttagttttacattttccggagagattcattcgattagccaaccgctaggttaaaatcgcggattgaaaaagcgaaattctttttgaaacaacctgcacgatctgcgcgttctcgatgcaatcagaatcgctatcggaaaaggttttggtgctcgcggaggaagagaaagaggaggaggaagaagaagaggaaaaacatagccagaacgtcggagtagagattatcggttaccgatgattcctccgaggcggaagaaatggaccgaggcggaggagaaaaccctaatcgacaagtacggggagctggtggaggacggttcgctggctaagatgcggacgcgggagaagaagttcaagccgattgcttgtcacgtgaattcggtgcatcacgttcgcgatcccgtggcgtacccttggcagtggagttggaaggacgtttcgacgaaggtgcagaacatgcggcaccagtatttgcttgtgaagcagaagatcaagaggcccgagttttctgggtccggaggaggaggggattgtgatgatgtgagtgagtttgactgggtggaggggcttactcattggtctaattttcttaggtataaggatgtgtttggggatgttgcacttgttgttggtggtcatggtgggaatgagttgatggggattgaggatggggatcacggggatcgtgatggggataatggggatggttttcttgctggtggtggggggatggatatggttgagtttgggcagatgggtcattccggggatggggatttcggggctgctatggatggggtggacaatgaggtgatggggttggggtttgagtatgaggctgaggaaggggaggtgaattacaatgggagtggtggtcgggagagggaggatgcagccgagaatggttttgtgtttgaggaggaaggggaagtcacagggtcaagtttgaagaagaagaggaaggcagtgaaggggatggagaagaaggcgtggaggattcttgctaaccagctggggcagttgagggagatggaggcgcggttcgagcagcgtgagctggagagggagcgtgataggcagaggagggagaatttgcgagtggagcttgataagcagtgggagaagaagcttgaggagagggacaaacttaggaggcagaggatggtggagtgggaagctatggagaaggaaaatgaagagatggaaaggaagaggagagaggaagagttgattcatgagagggaatgggaggagggaatgaattgcaggaggctggaatggaagaagagggttgacgagatgctgagccagcaccgagcagaaatgggccagatgcagactcgttttcttcatgagcagcaaaatcttactaaccaattgcttggtatattctcgcagtggcctgcccaacccgctggcctatctgatcacactagtgctagcaaccattatctttcacatatgatgcaaaatttgcatcatgtgaatggaattgttcacggtgacgctagggttgagggagataatcaagaagatcaattcattgttgatggatgaagtatctcttccattttgtgtatctgctggggaagtccaggaatatttctgttacaagtggcaaaaagtgcacataattgttgaatgcattcttaattgtactttcttcaattaggtattgttgtatactattataatattttagtgtaactaatcaatataaataatgttttttttccttgttttcgtccgtactgaactttgaaactcagaaactgagtgtaaaggtcacattttttgtccaatacatgctttaatgcttctattcaaaccatctattatctgaagcctataaaatgtaaatacattcaaggagtaattttctgttggttctttaatctgcaatccaacttattgtaatgctaatgaaacagcatatgacatttagccttattcatcctctgttattgttttctgctatactttagctaagttcatgtcctatattctttccaaatattcagttataagttaatccttgccttgttttaacccttatgcacatgtcagatgtgttactgtgtgtttggtaaaatgaaatttgaaatttaattatcttttttcctccttacatttttattcttacaaagttcacctatactctggcatgttctcctgtgtaatctttaattgctggatcttcttcatatttgattacaagattatagtaggagctatgaatgaagttgattcagaattatactagaatttttataattttttgtttcgtttcatgttttgataaatgtttatttatttaatattaactggtatacacacatctcatgccctaactcctatatacacacctgttgttacccataccaatgtgatgataatgggagtgagcatttgcaaacaatgcccattcacaactttcaattctgtttactagagttctttagtaagttgtttaaccacgagacataacatttgtcttattttatagttactaagttcaactatttatattgtctttcacttgcaaccatgtttatccctatattaatttgtaattatcaaatgttgcccgatgataaatttggccccaaatattccaatttcctgtactttttctccggtagaagtttccattatttttaaaatcttacacaaacatgattcagtttggataaaatttcttaacaagcatttataggtaaagaaaataaggaagcagaataaatcgattttcaattttgattttggagaagttagatgactgaacttgttaagaagttgtgggatataagttacttttaacttagagccaaaaatgattcatttgatgttcatatttcattctgaaagtagacttgcatcaagttaacttaagataaaataataaaactataccaactccccaattcctgatcagattgttgttcgttggagcatactaacgtaaagcttcatcacccacttattccaaagataaagttcagtttaatcccctcccaaaccaaataaattatgaagtagttcacagccacacatgtctataatctcaaactaatatttatataacacatattaaaaattattaatttatgattacttgattatatattacataaaaattaatatagtgtaagaaccaagataaatcataatcatttaataatttctcttcagaccaacataaccacgaccagtttctttcatgagagagaagataagagaaaaaatgtttttcaattttttttaaaaaagaatttaatattagtctttgaaatttttaagcaccatggaggtgaaaaaaatagatatccatataatggacaggatatctgaattgcaaaaaaatcatgaatctcttgtttaaaaacagttttatttaaaacatttattttttattggaatgttttcaagatgataaatgagacaaatcaatcaatcagacttggtattaaaaacaaataatttcctcgtgacattttttttttcataaacataactcaactaaagaaaaaaaaacagaaaattaaaacccggttatttgctgatcattaggaaaagaaaaaaaaatgggttggtaagtataactataatggggagaatcagcggtctacttagacatgcggtgggtgcacaccacaagcgcagtcagagaaaggaagcatgcactgcatctaccttaatctacctacccacacttttctatatatatatatccacccttccaagccactttgcaacatccatccaagccttttctttcgtagatagctactacttcactttcatcctttgctccagaaaattaactagctaggatggtgagtgttgaagagattcgtaaggcgcaacgtgcagaaggccctgccactgtcatggctattggcaccgccactcctcccaactgcgtggatcagagtacctatcctgactattatttccgcatcaccaacagcgagcacatgaccgagctcaaagaaaaattcaaacgcatgtgtaagatatctctctcttttatcctatcttcatttcattatataatatgcatgttgcttatttccaacatatacctttgatttcattaatgatatcaatgaaatttaatttattatttcaggtgataagtcgatgattaagaagcgatacatgtacttaaacgaagagatcctgaaggagaatcccagtgtttgtgcatatatggcaccttcgttggatgcaaggcaagacatggtggttatggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggcctagtacctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacattccgcggcccaactgacacccatcttgatagccttgtgggtcaagccttgtttggagatggtgcagccgctgtcattgttggatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccgtatgtagttacacataggcttaatttcactttttattgttaatctttttaatttttagtgaattttatccctaattttttaatttgacacattttattttcaatttttaagaaacttgtgaattttatcctctattatttatctatttataagcacaaaagttgggggaaaatttggcaacctcantaaaagtgaggataaattctgtcaaaaaaatttaaagttggaataaaatttggcaaaaactaataagttagggataaaaaaaatataattatgtaactagcaaagtgatgaaggataaaatttgtaggattattaaaagttgagataaaatgtccaaaatttaaagattaagataaaattcgtcaaaaattaaaaaattagaataaaaaatataattaaatctaatgtttagtttatctataagaaaaatttcaaacctgaccccatcttattgcaatgcataatggagtgggtcagtccttccataggatcaccctggaggccacccccctttttttttccctctatgaccttcaccattgacttttcctaatcatcaattcatcactttcgtggcttctcctaatgaaaacgtgttgattaaaaaataaacaaaaaaccaaaaatattgggttgttaaaataagagagtagtcatcagtctacgtagccatgcggggcaccacatagttgaaacaaagcgcagccacgagtcagaggaagcatgcatagcatctacgtaccttagcctacctaccaatatcaactatctatatatatccacctttccaaatcactttccaacatccacccccatcatcatatcataccctttctatcctacttgctacttcccacttccattcttttcttaaccagctaggatggtgagtgttgaagagattcgtaaggcgcaacgtgcagaaggccctgccactgtcatggctattggcaccgccactcctcccaactgcgtggatcagagtacctatcctgactattatttccgcatcaccaacagcgagcacatgaccgagctcaaagaaaaattcaagcgcatgtgtaagatatatatctctctcctttcttcatttctttatacaatatgtatattggttattttcaacatattcctttgatttgattagtgatattaatgaaatttaatttattatttcgatcaggtgataagtcgatgattaagaagcgatacatgtacttaaacgaagagatcctgaaagagaatccgagtgtttgtgcttacatggcaccttcgttggatgcaaggcaagacatggtggttgtggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgcccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacatttcgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaaggtggtctcactttccatctcctcaaggatgttcctggactcatctccaagaatattgagaaggccgtggttgaagccttccaacccttgggaatctccgattacaattctatcttctggattgcacaccctggtggacccgcaattttggaccaagttgaggctaagttaggcctgaagcctgaaaaaatggaagctactagacatgtgctcagcgagtatggtaacatgtcaagtgcatgcgtgctattcatcttggatcaaatgaggaagaaatcaatagaaaatggacttggcacaaccggtgaaggtcttgactggggtgtgctatttggtttcggccctggactcaccgttgagactgttgtgctccgcagtgtcactctctgatcatatatattgagcaagagaacaaatctttcttttttcatatgtattcttggctggccggtttgaaaaacgtattgtgtttcgattttttttcccctgccctgcaaatgcttctgtttgtatactagtaaataacaacttgttatactattttttcaattaagcttacacacaagttatctatatatgaagttgcaaagtgaatatcttttgtccaattttatcttcattgaaagattctctatgattgatgataaattgaactatagaactgtctcgaaccaggtttacttatgggctaattgtgtaaagagtgttgtgtatgagttatctgggtgtgtgagaaaaattatacagaagaattcaattagtatcaagtaatcgtggtagctaataaaatatacgtcctaccttgattacttaaagaacgaaatcttagttgacacaaaagtatggacagcgttagaaaaaaaatataaaaaatattccatatcacttaccagagtacaggcttcaaggttagaatttggatgatgaatggtttaagaaaagattataagcttccagtttttcagaagaatggggaaaccaacctcgacgatattgaagctgtctttaaagattctgaagtatgttgaagataattagacatgatattgatattgattttctgtgagttctggaatattatctcataaaggattttgcatgtgttttcaggagcaccatgtgacggagaagaacgaacagcagtcaacagcaatgaatgcatttgagttaatttctatgtccaaagggctgaaccttgaaaacttgtttgatacagagcaggtatcaagctgatatcattgaattggggaggaaaataacaaatgacagggacttgtttcatttagtgaactaaatgaaaaagtcaatttgatgaaaaaggtaaacaagttttattaagtggagttgtttctccttaccccctctaccaaacacaccattaaataaagtttcttcatctaatatcttttgtccaacttcatcttcgtagaaagattctttgtgattgaatataaatttaactatgtaaaccaggtttatttatggattaattgtgtaaaagagttgtgccgattaacttagcccactttggcttaaaattttctgtttgttgtgagttatctgagtcagaaaaaatattatacaaaagggatcataagtatcaattaaacctagttaattgataagaaaacacgcttccttcccttattgcttaaagaactaaatctcagttgacagaaataaggacaaaattattaaaaaagcaaatgttcatatcactgaccagagtataggctccagggttagaattggtggtgttattttatgagatgtatgaatcggtccttgactaattaaaataatcggttatattagcctttagagttattttctgaagtgaaaagtaagattattagttgctattaatttaattaaaaataaattctgattctattagtgcatgagatacaccattatttggcaataattttaaactcggcctgttgtagtggaaaattctgtagaggttagaaatggaattgattatattttattgtacagaagttaatgttttctgcattaataaaatagaaagtttctgatttctattgattcatagggttattttaaatttgcaatgttgtttccaaatgccactaagacacaggatttagaaggtttttaggatcagtgtagtaaggagtggtttcagtagtaggctagtagcaggaccaattttgtagaattcccttctgaaagagactgattgcagtagtatgaatattcaaactaagctccatttattcagctgaagttgacaagaagcaatctttaatttttgtagtatcttaattaaaaaatcagaaaaagatttctaaggaacttaagaacttctactagatatttatatttaagtataggatccgatgtcaataagataagtatattgtaaaatggagattctacttctaccccttctccctcaatctcatccaaatccaaattggcttaaagctagcagcatgatgatggtcctgtttttagttctcattgcccccacccacttttcacgcctacagtttggggagcattttgaaaatgatgctgatgtatgcacatttcaattttcttattggtgactttatcatcacttccttggactatccccaccttggcaccattcttagccccacctcacagaataagctcaccctttttattttagtcctatcgtaatgaacacaagtcataatatattgctttgtcccaatccaactatgatttattaccaaacttatgcctccaaataaatgtatatactaaattttatgacatatttgtaagtttttaattatttaaatgtaatgatctataaaccaagaatcgtaacaaaattctaatgtatataacagacaaatgataagatgcctaattgcccatattgcatttgtaaaggtggtccgtttgtgataaaacaactgaaagtcggccactccatcatttatcaccaaacattttctacattctattctaaccacaaaaagttttccaatttctttagcagtaattacattcacgtttttcgattttggtgttaatttattttttgaaacagaatacctttcagccgaaaaagtcaataattaatccttgaaaatattcaaattcatgtaaataattgatctctttcaacatatctttttctatacacacggataaaaaatcaaacttttaattatatgcttaataaacaaaattatttatcaatcgtattacaccattacaccatgttgattcattttattttggtgttaattatggtttgagtataattactgatgcaagtgtagttataactaatcacacgagattaatgcaattagtctatttctttaagatggttcatgaaccttcatacttagggtgtagaaaagaactagtctaacaacccacaagatttaaattaataataaactaatgttttgaaatcaattttttaaaatgatcaaactctggaaacaggttggtggggggggatagagatacgataagataattttgtgtgtgttccacatgcgtatataagtcaacgatctagatcaaaccattatcataataataataatcaaaccccattaattccaaggtgttgctgaccactttgaaaagaataacaagagtttttaaacacaaatcagtaaaacgtacctgtatccaggtttcctatgatgacaccctcaccaaatctagctttcttccagattgagctggattggatcaccccattatgctctagctccatgaaatcccatgatcgagtggtgtgtagctttctcccacggttctcgaacactgacaacactttggggtgctctaaaagcaatttggagaaaagggtaggtacacaatgagataaaggaaacacagagaatagaaaacagaggaactaagcagaggataaggttcttagttcttactagctatctcaacagctacttcttcgtccaaagttgcagcaaaaccattgatgtgccttgtgtacgagtaaaagatggagtctttggctgtattagaactacaaagaagcaagctcaaatcaaagcaaggtaaaaaattgtaccacttgagatgttataaattataattgcattttttgttcataccttcctaagaaagatcccagaaagtcatggtgggactgtgtcacttgattgaagtcaactgaggataattctgggccgtgtgagtgggctcccaagtacaccacatatgactacaattaaaatggtgcactgcagggattagactagaccacaaggattatttatctttttcaaggttgcaaattgcaatgcctcacctttttcactgcaaagctgggtctgtgcaatagacagactagaagaatttggagcagaaagtggatggaaggacttggtggcctcattgctttgcctatctaggaagccctcctttgctttttccttgttttgaatgtaacagaaacacaacctttggttttatagggtaacagtccttgtaaaacataaagtgactgcacctttgctccttaggttaaaattatatttaatgtactttcttgccatatcagattcatttcactaagtggttttaatacttttttaattttttacttcagagctacctaaggttttatttacataatttcttttacatggtattaatctttttttgtttttaccaatagtagaatttataatattatattagacttaaaaatagtagtattatacagaatcacactctctcaaattaagcacataggagaaatcaccaacgtgacagctaataattgccaaatataatattaacaaggtggttttatataaactctggttggaccccaaaaagaaatacccaaatatcacttttggactattgcgggtttgcgaaaaataacaaatgcagtgcttatttaatccgtgtgagtgtgtttcgagctaattaattagggcgaggattgaagaaatggatatttttaggtgatgtttgttttaagatactggatatatttgggaaaaaattgacaagttagctttaagtaaaaaaatagttaatttaagtagaaatatttaataaaattagttatacaattagctgtaaaataaaataaaagaacatgtttatgtgatttttatatattttttatttttttttaaatatacttttagttagctactgtttttaatttctgttaattttgaacttttatcatttttaagatcaaatatttattttataaaataaaacgacagtataaataatttaattattaaaataaatagtttaatattaatgatagacttttattaaaatattaatgacaataataataatctgtaaattattaaatcaacccttatttaaagtagtgtttgataaaaattgagttattaattatactaaatattttttattagctcgcaatataatttttatttagaatgataatgcaagtttatcgaactctataaataaactctggttggaccccataaggatatttcatttttggtctattgcgggtttgtgaaaactaacaaatgcagtgtttatttattacgcttaagtgctaaaataattcaaccaagctaatttattagggcgaggaatgagggaatagaagttacattttttttatagaaataatataagttaaatttaaagatatgttcgactggaatgtaatattttaaaattcaaatgattacataagtggaaatagaaatagaagttaaaaattggattataagataatttctaaatttgttttatagaaaattaacatatttttcctttccttagagctaaatataaaaatgtattttactgtagttcaacaatattagaaatattttttaaaacttatgccaaagataaaaataacatattgtataatttaacaaattttataacaaataaactgtgaaaaaggtaaatcactcgtgtcccttcctatatgtctttctttaaattttagttaaaaaacaatacttcaatataaaaaattaaaaaaagttactagtgttaaaagggaaaagaaatttgagtactatgttatcttttgatatgtatatataaaagggaaagagacatgagacaagtgaataaaacagataagttgaaggtgtatgttatccttaataatcagattgggacttgaaggttaacatcaaatactcttcagaaacggcctcgtgtaattattgaaagtgtggcagtttaatgtgattatcaatttagctaacaagcaagacaaaagaaagcattattgcaagaagactataactcaataagtatatataatgctgtgatgagattcgcaattaaaatagttgccggccatagtcatatttatgcttccaaaaggccactacttggatgaaaacctccacttaatttaaagaccaattttctaaaaccatgcgtttatttatttataaaacccctacgcggtaaaaataaataaaaattgctagattttgattctgccttctgaaaaaggaagtgcacattagcatattaattaaatattttcttccttctattttatttgatattaaactcactaatagcgtgattggaaccctccaaaaacaatatatatatatatatatatatatatatatatatatatatatatttgattaaaaatgttgaaataatatatatatttttatatttattatttcaaaattagaatacaaataagttgttacatccaaataaaaaataattataaataaaagtataaagatgttaatagcatgtgagactcattctaaatttttaaatagtgtaaatttgtacagtaatatatataaaaattaaactaaaaaaatttaatgagatttccaaatgtagtgggacattataaagtccgcttactactagagtgagttaagaacaaaagaagaatatactcttcaagatgctataatacaaaatatccatattccacatttatccaagtatctttaagagttaaggacactaaccacaagtatcaacatgtgtgactaatgagtgcgaggattgtgcaacaaatatatgaacatatgacaagatggtagaagcctggtctctcctttctgctggcagattaaggtgtggcccagtttttggtctattgttgctatttcttttctgcttttaggggcttatcctagccttagacttgatatttgtttttctaagaattgggctttgatccctcttaggccagtcagtccaaattagggctattgcttcatacacttccagttatttcctgcacaacttttttatcttatgaaatagtcaatccaaaatgtaaaattatattatggtatatttaacaacactaagttagtactaatatatttgttagaaagaatttgttaatcccattagacttagtatttaacaagcattttaatttgtgtgttgcttaggataagtgtttcttttaaatttattatataattaaaatttataataaataaatacctttaaacatgtaaattatattttaaattcacaataaataaccattggcaaatccgtgaaaaacaggctattgaaatttaatcaagacataaagataaaaaagtgttagattaaaagggtagaaaataaaaaaaatatagaatatacaaataaggataagaggaagataatttgagacaactgagagattttcttaacaaattgtaggggcagtgtgtggaatgcacatttagagaagagaataaacaaaatattgagaatatctaattaagagaatgaaaaaaaaaagaatatcactctctaagttgtctattctaatttatattataggaataaataaataataaaaaagtccaattaaattaattcctaataaaatttagcatatcaatcaacatcatcttgcgttttttcttgtttttttttttcttaattaaattgtatatacctatccatctttacagatgattgtcagcttttgcgaggtgggtatgtaagagccgtagttttcggctttgcccatttaacatacaacctaggctaataatttattaattgttagtctctttttaaaaaaatattattgttaatcattttaattcaattaacacttattttttttctaagctaattgattatattccggttttattcttcatcttcttgcccttcctttttcctttaatttccctcgaaatcctaaacacactctcttaactgtaaatatcacgccctataaagacaaggatatacaattattttgacattatagttggaaataaattttgctacaacaatcaaacatataaaatactattaagcaagtatcattatttccaataaagtattccctgcagaaattttgctccagagagaattaatcaaacaggatgtcaagcagaacatacatatacagtgtgtgggttctcggtaggactaaaccccattggccattggatggtgaaatgccaaaaagtatgacttaatttgttgcactgaaagaaaggcatgtgcatatatgtcgtttggaatatattaattatattatatatagagatgtctatgaagaggacgacgtagttgtgaggagaaccatgtcttcttttcaaatgggtagtaaagacaattctcatatatggctccaccgagcaactaccatatctttattccttgctagccctagcttttgacaaaagcgatgccaataatggttatatgcaaaattagaaagtaacctaaccaaccccacacttgtaacgtatttattgattaatacaacattacgtgcgattttctgttttacttgtgcatgcatgacgagaaaataaccaccttagttcaagttcaactcagacacgtacttgttgctttcatccatatatatctcattgcatgcatgctggctgcaacctatacatgaggtgtcagtggaggaaatgttattcttcacaacgaaaatgccacatatatgtcattcattttaatatattttgaggaataatatccaatgttttgcataaacttaaaattttcttattttgatttgacttgtgtataaactttaccccactaattgtggatcatattgccacagtggatgattaattaaagaacaaaatggatcgcactaatttggttgatttttgggctgtaatttattcaagttctcaggatcgttatctcgaagaacgaaatgcttgacattaatatcaatatgttcatgcattaggcgaatccctgtgttctcttctcaaagcttgaggtggtaaactactgtttttaatgcctggctatgtgctcgtggatagtcttactttttttttataagcaaaatttgattattgaaaatacttaaattgtacgcaagttgtgcccagtgcccaattaatttaagactttacattacatcaaattctcctattccaacaataagtagtcctaaagttgtgctctgtcttttccatcttttcaattttatttgcatgttagtttaatttattttaaaataatattttttttgtcaatttcatgagagtcttaaaaaaaattcttgaaaattattcattttcagacatgttagtttagactgtttttcctaaagtggcgtatatatgttgttttccaaatcttagctcgatcatctatagctgaatagtacgaaagtcccaatgaaaaattgcattcatacaataaatttatacatcttatacaacgctttttttttttttcgtatcacatacttatgccattttcctcctcttctcttcctgtttctctcttatttgtaaatagaagttgtataattttattttataaatataatttctcggcacaaatcacatgggtgggacagataatgggaatcatgagaatcaccttgtctttaaccacacatacctcccaggaccaaattaatctcctctaccaattaaagcagtcaagtgaagtttcaaaatctattagttttgcatatctttaaagtatagttgtgaaacttgatttggtctgattagttaattttgcatatctttaaagtatagtagtgaaacctgattcaattcgatcaattgagctggtctgatcatgatctaatattttaattggattggtttcactattgaattaattatgcaattgacttagaatgatctatccgattaggtattggatcccggttgaacagatctcattgattttataaaaaaaatcattttgaactcttattagtattaattgttattttagatttttgggtatgaatgaacttttcttactcaaataatattaattatatacttatatataatacatacatatataattttaaattttcaatatataacaagtcaaaccgaatcaattagtaactcatcgattaaactattaattcaatacctcgatcaggtcgaattcacaattattctttaaagagttcatttataaaagattcaaatctatagtttattattctttaaagagttcatttataaaggatttaaatctatagtttattgtagatcggacctttattaaggggagaaaatgtttatgtgtgaattatattaataacttgctctagctagcatgctgcaaaatcacatattctaatttcactaaattcaaccaactttatagcaagaaaatgctggatatcccgacatatataaactttggctaagccataccaaaatgacgcgttggtttttttttttttttatcaaaacaggaaaaaggttgttttttattatcagcaaaataaaacatatataaatcataggcacaaaggatacctaaaacccatactcatgaacagtatcatcaaatgaaaaataaatttatttctgtattttcttatttccatattcatttataaacttatgtctcaaaaaataaaacggctattggcatctctctgttttttttttaaaataaatcgtaattcatctcatctagttgaacacttacattactcctataatctactgtatatctcaattataaatttataataattctaacaaaagagggacatatcaacaaccacaatcttcttttgtaaaggcaacctatgccaatgggatagggaacttcttgcgcatttcccttcccgggatcttcgactattagaaaatgacactatatatatacaccacatggttgggtccattattgaagccccacttttgcatcatccccttcccggttgcatgcacttcctttatgcatgataggtgtaattatgatctatgaataatataatcctcagtttttttcacccgacaagttactaaaactaatttaattaaaattaatgatattaattacaatgacaataggtgtctcataagtctcttaattatcattatctttttttaattatgatattaatatgaagttgtcttcataaaaaaatgataaattttattagaaaaccttgagtatatacaagataaatatttttttaatataatttatttcatattcaataattaataaaaatttgaaccatagattagttaattaagaaaaatacacaattatcatttatgttaattattgttggtattattatctttttttttcttccttccttatcaaggactctctttcttagtgttctatacgtatcttcctttgtctacaactctatatctgtagttttgccaattacaaaacagagagtcgtgtttaagcatttgaaatattaaaataaaatgtttcaaagaatagtatattattataatttcgttttgacttatgaataatgcttcaaaacagagagttgtgtttattattattattctttctatttggaaatatctactaatggatcagaatagaatagatgtccttcggctttccggataagagaagctttattttgaacctagaactgtctagatgaaaaagttgatgatgtatcaagtttcttgagagatttacttaattttaacaatatttctatgaaaattatgtcaaaagctaacttttaattaagctatatatatatatatatatatatatatatatatatatatatatatatatatatattcaccaaaaaaatatacatatcatttataatatttcgttttttattcattactaactaaaaataatttctactgttagtctgttacacaaatatcgagatatttcatttcattttcaaaaattaaattaaagtaaatcattttaataatttattccgacatctaaattaaaatacactcatttatctgtcatgatttctgtcgcaatatttaatacgtaccggaaactcctgccaaaacttgaattggaataaaataatttccataaagaagaaagtgacaaatatccattccaattcctgtatgatgttttttttttttttttgcaataaggaaatttttaatattcaatcccaaaattatgaggtactgtaattttattttattcttttcaggtttatggtaatctatgtatttttttcattccttttatataactgtataaatttagttttaccatatagctgtttaattcaacatatccatgtattatgcgtgtaagttttttagtaactatctttcaaatgtttactactattaaaattgctattttatactaaaaaaagctgtttatttatcaccgccataaatttaaatgtattcactagatcagtagatatgtttgtaaaatttaagaaattcacgcctagctatatatatgtaacaattttttttttttataaagaatctatgcataagtcactacggaaaaagacatatttaactgatagttttctttaatgacaattttaaattatctttgaagttaatgtcgtcaaaatttaagaatttctacaatgatttttaaaaaaattattttagaaaaatataattttaaaatgatttttaaataaataactatcttaagataattttaacttaaaaattgtcttaaaaaagaatcattagaatatatttatttaaaatatatttaaaaaattgagaattttaaaataatttttatttgaaaatcattttaggatgttttttttaatgaaattttttgaaaaataaccgtcttaaaatatacatttttttaaaatatataaatactaagattattttttcaaaaatcatcataaaaatctactttgtaagaaagttgttcgagtcttaaaatgtcttttaaaaaaaaaatagactaagatgacccagccaaaccacaagccatcatcttctgactctaaaaaaaaaaaaaaatactaagttagcttccctgaaacaaaagatttaagaaaggaagaaaacaatgtgtttttttggttatcattacctcaactttgtcattgttgcatatgggaacggtaaggagttgttgtttcttccttgtttcattgagtgaggtgtgactcgaccggcgagtcaactcggtgaagaagtcttcatcgtcgctactcttagtcccggttgaaccggaatgaactagttaagttcctatcgagtcgaactcgtaggaaaactcagacgagaacccgaacgcaacgtccaactcagtgtcatccatggctcactgggtgaacaaaagattctaacttgaacttgaaaggaaaactgacatgaaaatataaattatgggaggtgagccatggcttttgtggcttcaggtaataggcatcgtccatgggttgggccttgtgccctcggaaataagcgggtcatggcgatctggatggcagagttaactttgttagaggaggcggagacagaggaaagagatgtttaaatcactctttgtctttgtttctctctctctcccgttgaagacctagatgacattcgacagaggagagagggagaaggagaacatgaagaagacaacgagccagaggagaggaacgagcgccaacatttcaaagttaaaattatccacatttaaagtcgatttcgcgagaatcatatttgaaatgttggtaataattacaaaattattaccgcgtttaaaatgatgatgatttttggaccatcgttgttaaacacatgtcttaaaatcatgtatttttagcagtgagttgcgccaaagtatatcacgtaacttgctcagtcttttgaaaacaatctatttgtctgcaacctaagtagaaaccagctattgtaattaaaagtttaacgctgcatgatttgagttctgttttgtcggcggggactagggacaaatatattttttgttagttaatttgtatatttattggtgatatgtctgaagttaagttaattggccatgcatgtgtgtgtgtgtggtagtgagaagaattgagaaaaagaatgtggtctccaaagtccaaccaatacaaatctctagctctccctccctctctcttgtatccctttatatgaatcttctcagacacgttttcgagagcccctttttccttatcatagcctcgcagcagctgatatctcatgttgttcttgttcctaacaaagtagcattaaaaaccatggcatcttcaccggacaccagcaaaaccataaagctgatgcgttacaacagctacctccgcagactcaacagcttcaaactccttaagacatccttcatcctcctcctcctcctctacaccctctccacccaccacctcctcctctcctccgccttccacggccccgcatgggagaatcaggtccgccactccgccctcccccgccgcccccacggcatgtcggtgctggtcaccggcgcggcgggcttcgttggctcccactgctccctctccctgaagaagcgcggcgacggcgtcctcgggctcgacaacttcaactcctactacgacccctccctaaaacgcgcacgccagcacctcctcgccaaacaccaaatcctcatcatcgaagccgacctaaacgacgccccgttgctcgccaagatcttcgacgtcgtttcgttctcccacgtcctccacctcgcagcacaagcgggcgtccgctacgccatgcagaacccccactcctacgtggcatccaacatcgccggattcgtaactcttctagaagcttccaaaaacgctaacccccagcccgccatcgtttgggcctcctcgagttccgtctatgggctcaatgacgaaagcccattctccgaactccaccgtacggaccagcctgcgagcctctacgcggcaactaaaaaagcaggcgaagcaatcgcgcacacctataatcatatctatggactctccctcaccggattgcgcttcttcactgtttatgggccctggggaaggcccgacatggcttactttttcttcactaagtccattctccagagaaagcccattgacgtgtaccagacgcatgacgagagagaagtcgcgcgtgacttcacttacatcgacgacgtcgtcaagggctgcctcggtgccctcgacacggcggagaagagcaccggcggcgtcgtagggaagaagcgcggccccgcgcagctgagagtttacaatctcggtaacacatcgccggtgccggtgggtaaacttgtttccgtgttggagacgttgctcggggtaaaggcgaagaagcacgtgatcaaaatgcctcgaaacggcgacgttccgttcacgcatgctaacgtgagcttggcgtggagggacttggggtacaagcccaccacggatctcgccgctggtctcagaaagttcgtgcagtggtacgtcgggtattatggtgttcgcttaggggtagaaaaggaaaaacacgcagacttggcttgattcatcctttccgtgcccctccattcatttattataattatatgtttttttgttgaaacttgtgaatggtgctggcggcccatgtgagaatgcataatcatgatttggtattttaataaaatgctagttgcatccagtattattatctgtgcacccaacacttaagatgaaatgacaaaaatatctttgatccgtaaatcatttaagttgatctataagagtcttatggatcaacttaatccgtattgtttcgtaaaaggtttacggatcatattgatccgtatcaaccttacggatcaacttgatttgtacgatttacggactatcctcacacacattcatcacaaatgcggaaaaagtgtagagataattttggtatttttataaacttgtgaatttcaacaagtctgcgtggtgtggcaccattcacaagtttcaacaagttttattaaacttgtgaatataaacgtggtatataggtccaaggtaataaaagcaaggacaagagcaagtgtatatatgtaatctatgtgtgaggtggtggagggggagctgagctgtattaatgatgggtgggctctactttaagcttttccaacttattattgtattttcaaaattaagttaaattgtgtatagacaataattatatgacatagacatgcaattttcttacaattatattactgcctcacttctaagacaatgatattttaaacctgtgacccactaattcacaaacatttaattgatataaattttaaataaaatattctcaatttattaactcattttgttataagctaattatcccattagccatcaataacaataaattttactattcatcgactattttttttatgataaatgtctcttttaattgcatgtgttaattgatctttttaattatgcttaagaatagtatttaaaaaatagtttaaaaagctaaaaagattattgttttgaaaaaaaatagaaagaccatttgttttaggaaggagggagtattatatgcaatagtctgtttatcattaaatgaatattaatttttgttacaattttttataagtcgtgttttttttactattttttaaatgaaaaatgaataatttaatacattctcaactttttttatatttagtttagtgtagtgaaattaagcacaatttcaccttttttttaaattgtttaaaattcacgactccgcattatattataatatattgtgttaatattattagtaaataattttttctcatttactatttggttgagagaataaggttatattattagcaaatgcattatttgacaaattttaattaagttcctaaattattttttttcaattgttctcttaacttatatttttttaaatgatgttcctaaactattaggaataaatgtatatgtccaagaatcaatctgtcatgtaactaattaggaataaatattattagaatttgatcatcatgtactactataaaacaattgattggataatatctttaattaaaatcatggactcattatcataaactagtattgtataaatttaatccaaattaatcttgattataaaaaacaagagacatccaaattcaaaaaataatagcatttattaaataaagattaataaatttcatttattaaattacacatatagatgatatatatgtgaatataattctaaaagttaataacattactttaaattatcaataaaaaattcataagaaaaaaaaaataattttgttttacttaaaattatcataataattaataagttctttattatattttaattttggacatcttctatctattttttaaacaagatacccaatatcttaaggtattagttgaatagttattaagtaatgactaatgagtctgagttttatttaaaacaattattttttcgaattatttttctgggcgataaatgaacttaaactaatcatttacgcacaatattaaaacaagtaaatctctcgtgacatttctttttgatacacttgaaactgatcaaaactaatttcttaccagggatatgagtccctttcattcacatcaacacacataacagtaagtaattatttttccaaaaactctaaccagaaataaaaaagtaattccaaaattaggagaagcaattgtaaagaagtatggactatggagaacaaaaaaaaaatttgctgattattgggggaaaagaatgggttggtgtgttgggagagtcaacagtctacttagacatgcggtacatacaccatatatttgaaagaaaaaaaagcgtagtcagaggaagcatgcgcgcatctacctacccacccttttcaattatgcatgtatatatatatctgagccactttgccacattcattcccaccctcatacccttttctttcgtgcctagctactccttaattactttcattctttaatttgctgcaagctatagcttcattagttcattcacaaaattaattattacaatggtgagtgttgaagagatccgtcaggcacaacgtgcagaaggccctgccactgtcatggctattggcaccgccactcctcccaactgcgtggatcagagtacctatcctgactattatttccgcatcaccaacagcgagcacatgaccgagctcaaagaaaaattcaaacgcatgtgtaagatatctctctcttttatcctatcttcatttcattatataatatgcatgttgcttatttccaacatatacctttgatttcattaatgatatcaatgaaatttaatttattatttcaggtgataagtcgatgattaagaagcgatacatgtacttaaacgaagagatcctgaaggagaatcccagtgtttgtgcatatatggcaccttcgttggatgcaaggcaagacatggtggttatggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgtccctccgtcaagcgttacatgatgtaccaacaaggctgctttgccggtggcacggtgcttcgtttggccaaagacctcgctgaaaacaacaagggtgctcgcgtgcttgtcgtttgttctgagatcactggagtcacattccgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaagttggtctcactttccatctcctcaaggatgttcctggactcatctccaagaatattgagaaggccttggttgaagccttccaacccttgggaatctccgattacaattctatcttctggattgcacaccctggtggacccgcaattttggaccaagtggaggctaagttaggcttgaagcctgaaaaaatggaagctactaggcatgtgctcagcgagtatggtaacatgtcaagtgcatgtgtgctattcatcttggatcaaatgcggaagaaatcaatagaaaatggacttggcacaaccggcgaaggccttgactggggtgtgctatttggtttcggtcctggactcactgttgagactgttgtactccgcagtgtcactgtctaatcatatatattgagcaagaacacagatccttcttttcttcttatgtattattgcttttttagtttgaaaaatgtattctttctcttttgctttctcacattcttcttttttgtataccagtaaacactaaacgagaacacatcttattattaatgcaattaagcttatacacaattgatctatactatacagttgcaaagtgaatatcttctattttatttttaccaatttcatctccaacaaaagattcttcgtgattgtgtataaattggactgtagaactgtttggaattatgtggtttgtgtaaagagagttgtgccgattaacttagtccagtttagcttaaaattttctgtcttgggtgagttatttgactgtgatatacaacattatatgaaacagatcaataagtatcaagtaaaccgcagtaaaaaaaaaagtatcaagtaaacctagtagctaagaaaatgcacttcctacgtcatctccggaggactcttgctcaaaagaggtggaagtcttgctatggagatttatacggacgaaaattatgtagattcagtaagggatatgttggaaaaccaccttaattgccgtcagtcctatccttctttagttggggcctctttggggttgccttaattgaaacttcaaggatgatggtttagtcccacatcgaattaaagatgtggtttaaataaaacttggacgatcttcatttaacgtcgattttttggggttgatttagtccctaatactaagaaagtatcctaccatttttttagcctattgggccacccactattgaattgttattggaccaaccacatatttcctgttattcttgattatcagttgcctaaataggaagactcttgagtcatgattgtattgcaaagtaagcaatgatacatttttctacaattaattatcttcaataatatgatagtattgtttttatcatattatatatagtttgtatttgtaaacatattataatttatgactaaaacaggtcggtgataaggaacatttttatcagaaaataactactaattctaacattggagcctatactatacctggtaggtgatatggatatccccccataaacgtgttaatacctacacacacgtgttatatgtggtgaaatagttaactgatgtaaaatcaataatccgaaatgatgaccatactttttgtcccaactgagatttaattctttaagtaatcaagatagaagtgcattttcttagctactaggtttactagatatttatagtttgtcagattttaagggtgtgataagaattacaacttggttgtgacaggttatgctaatgacaaataaatgctaatgagatatcaaaattatgcttttatgtgcaaggttttaaatggtcattcggttttaaaatgctcattacataagtaaattggttggtattaatacatcacaaaactccatgactgaaacaaactaacaaatgtccctaaattgtgacagatttcacaataaaccaaggcccctaaaacagaatcaaattggtacagacgtaaaaaaaaattgacacaccataaccagaaacaaactaacataccatgattagaatcatattggtatacaatggccagagcagcagagccaaattggcaccccatgagattgtgataaatttcacagcacaccatcacccgaacaacaaaacctaaatgatacacagatagaaccaaatcataaattacaataagataaaaactgaaacaaattgtgtcacaaattttacatattgaatcagaagcacaccataaactacaatctgataaaaactgcaatctgatactcaaccagaagcacaagataaactggaatatgataaaaactacctaaagtgataaactgcgttatgatatttcatatattaaatcaaaagcacacaatgaaaatgtaatacaaactgaaacaaattgagtaatagatttcacatattgatgcacaccataagctgcagcatgataccaactgaaacataaattctaaccttagagcccatactacacctcataggtggtatggaacatttattttaaagtgttaatacgaagtcatggataaatgttatctattgtggttaagtagttaactcttgtaaggcaaataatgcgaagagcagtccaaccactttgtcgacttagattttgttcattaagtaatcaaggtaggaagtgcaatttcttacctactaggtttacttgatacttattaatcccttttttataatgtttttctcacagactcacagttagataactcaatcaacacaaaaaaaaaaaaaaaaaattaagcctaagtggactacgttaattggcactattctctttacacaattaagccataaacctgcaaagttctacagtcacttttatagcaagtcacaaagaatctttcaataaagatgaaattggacaagagatattcactttgcaactgaatatatagatgaattttgtgaaaacttaattgcattaatagtaatataacatgttcttatttactgatataaaaaaagaagcatgtgagggaagcagggaaaaaaaggaagagaaagaatacatttttcaaactcaacatgaaagaatgaataagaaagaaaaggacttggtcttgcacaagatatatggattagacagtgacactgcggagcacaacagtctcaacggtgagtccagggccgaaaccaaatagcacaccccagtcaaggccttcaccggttgtgccaagtccattttctattgatttcttcctcatttgatccaagatgaatagcacacatgcacttgacatgttaccatactcgctgagcacatgtctagtagcttccattttttcaggcttcaagcctaacttagcctcaacttggtccaaaattgcgggtccaccagggtgtgcaatccagaagatagaattgtaatcggagattcccaagggttggaaggcttcaaccaaggccttctcaatattcttggagatgagtccaggaacatccttgaggagatggaaagtgagaccaacttcgcgaaggtgtccatcaatagccccttcactgtctggaaggattgtctgggcagtccagacaagctgaaacaaaggcttttcaactggtaaggggtctgatccaacaatgacagcggctgcaccatctccaaacaaggcttgacccacaaggctatcaagatgggtgtcagttgggccgcggaatgtgactgcggtgatctcagaacaaacgacaagcacgcgagcacccttgttgttttcagcgaggtctttggccaaacgaagcaccgtgccaccggcaaagcagccttgttggtacatcatgtaacgcttgacggaggggcgaaggcctaatagtttagtgagctgataatcagcaccaggcatgtcgacaccactagtggtgcaaaagatgagatgggtaatcttggacttgggttgaccccattccttgattgccttagttgcagcctcttttcccaactttggtacctccacaaccaccatgtcttgccttgcatccaacgaaggtgccatgtaagcacaaacactcggattctctttcaggatttcttcatttaagtacatgtatcgcttcttaatcattgacttatcacctgatcgaaataataaattaaatttcattaatatcactaatcaaatcaaaggaatatgttgaaaataagcaatatacatattgtataaagaaatgaagaaaggagagagatatatatcttacacatgcgcttgaatttttctttgagctcggtcatgtgctcgctgttggtgatgcggaaataatagtcaggataggtactctgatcgacacagtttggaggagttgcggtgccaatagccatgacagtggcagggccctctgcacgttgtgcattacggatctcttcaacactgaccatcctagctagttaattttctgaagcaaagaatgaaagtgtagtagctaggaaagaaaaggcttggatggatgttgcaaagtggtttggaagggtgggtatatatatatgaatagatagacagttgaacttgaagtgggtaggtgagtactgagtagatgatgagcatgtttcctctaacgaattggctgtgttctgtgttttctctcaactatattgtacactgcatgactatgttgactgttgactatcccattataatgattatatatataccttacaaatttgattaaaaacacgttaaaatgattctcaaataaatagatttggataaaaggacatagtcatttgttgacagagaaaggatatagtcattgacattataaaaagggagtgtatcgtatcaacatcatcaacaaagtagctttaatgttaatagtatttagtaattcaatttgatttggattgattcagttatttctggcaaaactaaaatcgactccaatccaatgaacaattttttttttcttgagatgcaaaggatagaaatattattaaaagcagcttagctgcacaagttgtgcccctactgaaagttatatcagaatacaattttgctgtgcatcaaagctatctaccagcaacatgttgcataattacgaaaaaaatagctttatcttgctgaacttggcagagcctctaaacatttacgaataattcagccatccgattatagaacataaccacgagaaaataaaagcaaccacctatcgctatcagcaaaccaaatgaagcaccagttgaacgccttgtattcccaccaccgaataccaaaattgaataaatttgattttgagaagaaaaaaattgcttattattattgttgatgtgaaatccacagaacctgtcacacataaacccattccaaacactgatgcttcccaaattgcattcgatgaaaatgctgacccaatcatccttaaagtttcccaaaggttttctcgatctcactaaattaaattcaacaggaattaggttgggttttaatttttatatctgtctttattaatcggataagtgaacaaattcgtaaaagtaaaagcgtaagacgctgttaatttagtcttgaaagtgctaaaatgaccaaaggtaactcattttaatccaaagtttcaaaggtcatgcgatgtaaatgacaataataacatactttcgaaattaaaatataatatagttaaattaaatttaaatactaaaataacaacataggaaattttaggaacattttttgttttcttgagaaaataaactttgttgttatttcattttaaatacaaacctaattatttaacaagagaatctatgtttgattttccaccgtatgtagttacacataggcttaattgcactttttatttttaattttttaatttttagtgaattttatccctaattttttaatttgacacattttattttcaatttttaagaaacttgtgaattttatcctctattatttatctatttataagcacaaaagttggggtaaaatttgtcaaaaaaaattaaaattaaggataaattttgtcaaaaaaatttaaagttggaataaaatttggcaaaaactaataagttagggataaaaaaaatataattatgtaactagtaaagtgatgaaggataaaatttgtaggattattaaaagttgagataaaatgtccaaaatttaaagattaagataaaattcgtcaaaaattaaaaaattagaataaaaaatataattaaatctaatgtttagtttatctataagaaaaatttcaaacctgaccccatcttattgcaatgcataatggagtgggtcagtccttccataggatcaccctggaggccacccccctttttttttccctctatgaccttcaccattgacttttcctaatcatcaattcatcactttcgtggcttctcctaatgaaaacgtgttgattaaaaaataaacaaaaaaccaaaaatattgggttgttaaaataagagagtagtcatcagtctacgtagccatgcggggcaccacatagttgaaacaaagcgcagccacgagtcagaggaagcatgcatagcatctacgtaccttagcctacctaccaatatcaactatctatatatatccacctttccaaatcactttccaacatccacccccatcatcatatcataccctttctatcctacttgctacttcccacttccattcttttcttaaccagctaggatggtgagtgttgaagagattcgtaaggcgcaacgtgcagaaggccctgccactgtcatggctattggcaccgccactcctcccaactgcgtggatcagagtacctatcctgactattatttccgcatcaccaacagcgagcacatgaccgagctcaaagaaaaattcaagcgcatgtgtaagatatatatctctctcctttcttcatttctttatacaatatgtatattgtttattttcaacatattcctttgatttgattagtgatattaatgaaatttaatttattatttcgatcaggtgataagtcgatgattaagaagcgatacatgtacttaaacgaagagatcctgaaagagaatccgagtgtttgtgcttacatggcaccttcgttggatgcaaggcaagacatggtggttgtggaggtaccaaagttgggaaaagaggctgcaactaaggcaatcaaggaatggggtcaacccaagtccaagattacccatctcatcttttgcaccactagtggtgtcgacatgcctggtgctgattatcagctcactaaactattaggccttcgcccctccgtcaagcgttacatgatgtaccaacaaggctgctttgccggtggcacggtgcttcgtttggccaaagacctcgctgaaaacaacaagggtgctcgcgtgcttgtcgtttgttctgagatcaccgcagtcacatttcgcggcccaactgacacccatcttgatagccttgtgggtcaagccttgtttggagatggtgcagccgctgtcattgttggatcagaccccttaccagttgaaaagcctttgtttcagcttgtctggactgcccagacaatccttccagacagtgaaggggctattgatggacaccttcgcgaagttggtctcactttccatctcctcaaggatgttcctggactcatctccaagaatattgagaaggccttggttgaagccttccaacccttgggaatctccgattacaattctatcttctggattgcacaccctggtggacccgcaattttggaccaagttgaggctaagttaggcctgaagcctgaaaaaatggaagctactagacatgtgctcagcgagtatggtaacatgtcaagtgcatgcgtgctattcatcttggatcaaatgaggaagaaatcaatagaaaatggacttggcacaaccggtgaaggtcttgactggggtgtgctatttggtttcggccctggactcaccgttgagactgttgtgctccgcagtgtcactctctgatcatatatattgagcaagagaacaaatctttcttttttcatatgtattcttggctggccggtttgaaaaaacgtattgtgtttcgattttttttcccctgccctgcaaatgcttctgtttgtatactagtaaataacaacttgttatactattttttcaattaagcttacacacaagttatctatatatgaagttgcaaagtgaatatcttttgtccaattttatcttcattgaaagattctctatgattgatgataaattgaactatagaactgtctcgaaccaggtttacttatgggctaattgtgtaaagagtgttgtgtatgagttatctgggtgtgtgagaaaaattatacagaagaattcaattagtatcaagtaatcgtggtagctaataaaatatacgtcctaccttgattacttaaagaacgaaatcttagttgacacaaaagtatggacagcgttagaaaaaaaatataaaaaatattccatatcacttaccagagtacaggcttcaaggttagaatttggatgatgaatggtttaagaaaagattataagcttccagtttttcagaagaatggggaaaccaacctcgacgatattgaagctgtctttaaagattctgaagtatgttgaagataattagacatgatattgatattgattttctgtgagttctggaatattatctcataaaggattttgcatgtgttttcaggagcaccatgtgacggagaagaacgaacagcagtcaacagcaatgaatgcatttgagttaatttctatgtccaaagggctgaaccttgaaaacttgtttgatacagagcaggtatcaagctgatatcattgaattggggaggaaaataacaaatgacagggacttgtttcatttagtgaactaaatgaaaaagtcaatttgatgaaaaaggtaaacaagttttattaagtggagttgtttctccttaccccctctaccaaacacaccattaaataaagtttcttcatctataaaatttcttatttaaataaagtacttaaaattatatttttataaatttctttattctggaacacattctgatttcttgattttcttattggttgcaatgtgaatagaatagtttttaagtgttatattttctttgattttccaatcagtttttaagtgtttgatcaattgctttggcacttggctgaattcaggtgcttatgggcagagagcagttctcaagtttgctcagtacattggtgcttatgccattgctggaaggcatacccttgatactttcaacaattagcttcaaacttccttcagtgagcatcgccttctcatcctcatcgatccaagaacagatcaccaggttaaaaggaaacgagtttgactttagccacatttgatttggctttcttgcatatttcgacctctctttttgaatattaaaaaaatgatactggagtatattaattctctgttctagaaaattggttatgacaagacagtagtagtttccaaatattacatgatgtcaaatgttagatttagacccctatactaatttaccttgtgttttacttttaattcaccttgcagtcaccattacttatcacatccttgaaaccagtcagtttcaagatttagacaacctacaaagagggaactactcttaaggaaatacaagtacgtttaatttctttattctggaacacattctgacatgcttacaagtatgtttacaattatgaagtttcttcccgttactagcttgcttttagtgagtgatacttatgtatggatcttgaaacatgtagatgagatgcttcagaggatcatcccccaacttgatttgtttatgaacacagtggagggtagagataaactttaaggtggagctactgaaatctaaggtaaaagctttactaattttaccttagacaataatgcaattttcactcttcataatattttgcttttgtatttctgaatcataaaaagctttctctggattgtccactctaaggatcaaagtaagaataaggttaaccatttcttttattcattcctttaattttctgtgtactgcaattcctcaaccaactcttctattttctgagtgtttagctgtgttgtagtaaagatattgccattggaacacatggtttgatatctgtttgagattttaagtttggtagtttactttaaatttgtaaaaaatacttgtggcaactcacaagttaatatgttgatatatatactttctacatggtaagatcaaggggacgtgacaaacataaggatccatttaggaaagactctaccaaaccgacttttaaggtgatgattttttcccacttatatagtttatctcgacactatctatattcgatgtgggacttcaacattaagtaaacatagaaaatgttctttctaccttgattatttgaagaactatatcttagttgacacaaaagttaggacaacattataaaaaaatgctccgtaacacttactaggtatagtgtaggctccaaggttagaattagtagttgtattcagagatgtattgattggtccttgactaaattggattagtcattacttgctataaatttaattagaaataaactacgattctgttagtgcgtgaaatgaaccattatttggcaattttaaactatgatagaggcaatctttcctacgtgttattagtgactagaagtgtcattgatcatatttattgtatcaaagtttatgttttttgtagtacaaaaacagattgtgatttctattgagtcagggggttcttttaagtttgcaaagttgtcagcgaaatgcagagatacagaatttgtagtgagaacagaggcagagtattatttgatgggtcaaagttcttttaaaatagtttaatggtcactgatggtgtaaaatagttttacatcattatccaatcacaaattattgttgatataacttttaagttttaaaataattttaaaatagttttactatatatggtaagttgtaattggatgacagtgtaaaacagtctataatcctttttctctctacaatattaagtttaaatattaaatattgggaaaaggaggaagagagcatgattggttaatagcatttttaaagggctggtaaaacatctcttagaattcattgtgaaattgtaaggaaaagaaaggaggctttactatgggacaagaagaaacatccagaatttctccacaatccacttgaagtatatagccacaaaatgattaagtttttattcttcaaattatgcacatgttaattgttcatgcgggtgttctgttttagtgaggtaagtactaagtataagtacacttatgatggtgagttttcttgtgttaagttctgcacctagatttttcatggtagtacatgacaattttctgcagcagttattgtcttaccgaaactttaaacaagtttcatgtgtaagaatacaattaagctgtggccatttactgagatatatatttgaatctcattgcttgttatttgtttccttacatgagaggttaaagtttaagttacagcaaagacattgtgtccctaacattctaccggtgttattacagttttgtgttagaaacgtaaacaaacagattagataaaacaagtggcacgttttgatgtaagtatattgtaaacacatttggttttatgcatgttaaagtgtaaatttgctggctgtgtatatagggattaaatataattagttttcttttaatttcctgttgtttataaatgtaaatgtaaattatgcataggatttaaattattgtgtatatcttttctcagtttattgcttataagtttatgtgtggcttttctaatccaagagtgcagtttgaacctaaaatcattaaattattataattacaaaattatttatttgcacgaagcagtatatcttatacaacttattctgtatatctttttttagtttatttcttataagtttatgcgtggtttttttaatccaaaaaagtgaagtcacatatctcatacgacttattatctttttataaaaatattcaaacttgtctatgtttagtttttctttcacaccaaaaaaaagtttttcctaataaaaaagataagtggtgactgtggtgtatgagaaaaatagtcctaaagtaattttttttatagaaaatatacaagtagaacatagaacgaaatcaaagtcgtgctttgtctaagttttaaattttttaaaaggaaaattgttaattaaaatttgtatttttaattgacacgacattcttaccaaaataaaacagcaccttaccaaaaaataaaaaaattgacgcaacattaattaaaatttgattttatttggtgtcaatataccatgtttgcaagtacgagagacaggtgtcagaccaccaaaaaaagagacagatgttagtttggtgtgcattttcttgggttagtgagatttccatttccaaatcataatgaatgactttttttttttacgtgaaacacatgaatgattttggattgtccaatttttttgggtaatgtactaatgtcgataatttgaatagaatcatctctattgattttctgtccaaaaaaaattcatctcttatgatttccaagacaaataaagataaaaaaattagaaacgaagaaacctaaaaattaaaggataacatagctcacattaaacaaacgtagctgacaaaaacaaaagtttgcctaatttttttattttttaaaattgcaagtatcttctatcgaagacgatcctatttaaattagtaggaatccgacgcgaaagttgatccacgcttgatggttgcctaatattgaagataaacgttaaaataaaaacaatggataagactagagcaaccctagattgtcttatttaataaacttgtgtatcagtaagtacggagctaggagaaaacaagcatccgtttattccaattatattatatagttttcaacggtggttgcagttgcgaactaggcacgaaaggttgaagaagatgctgcgtaattccaattccagaggaggatttggatcaggaatggtagtggcagtggtatgtgtgtgtgtttgcgtagtagcaatggagtatggagtaagagtgacggagggggaagagtatttcaaaccgttcaacgtgagctacgatcaccgcgctctcatcctcaacggcaaacgccgcttcctcatctccgccggaatccactatccacgcgccactcccgaggtcaatttaatttaatttaactcatcatcagtcatcaactaaaataacactaacatgcaaccacaatttaactcaattatcttttttctcttttccatcaagttgagttacaagcttgtttgctctgtttttttttttttttttttgcttctgtttgtttcagtgccttaatgaatctcgttctggttcgttctcaaaagtcaaaatcctatttgcgtgtttggattactttattttgaagaagataatcactgttttttttttcttcctgagcatcgcgttatgacattattatcagcttttgagctttagttcttctgaatttcttcttctttgtacgattagcgaattgaaaattcttctgaaacaaaatcaacaaattaaccgcagctcttattatcagtctccgtcaacgtttttgccaaatttggagcagtgcaatatagtctaataataggatgttaaattctgtgatgttaactttatgaaatttattttgttaccgtggcttattatacatttggtatgattttagatgtggcctgatttgattgcaaagagcaaggaaggtggggcggatgtgattgaaacttatgttttctggaatgggcatgagccagtgagaggacaggtgcaaaattatacttctcactacgtcttgtttcttccgactgtagatttgatatttgtttattaatgctgaaatattaatttctttttcatttagtgtgctttctcttgtgcagtataattttgaagggagatatgatcttgtgaagtttgtgagactagctgcatcccatggactctatttctttctccgcataggcccttatgcgtgtgccgaatggaactttgggtctcagccttttctcatattatcattatttgatgtttccatttagataaacaacttgaagagattgcatgatgatagttaattaattacatttctaaacaggaaaattccttaatcgtgtagtttccacggattttttatgctccgttctaggatttttacattcatatctagttgaaagtcatcatcgtaatatttggtgtgagactgagtaatagttttcatttagtcatttacctttgatgccaatattagtttatctttgctgatttatatatgtcaaattggaagttagtaaactttttggtttagactgtaaattaatggtggaaagtagtgttaaaatatgacaaaataatttcaactttgtccaaaagaaactaaaatggattgtgcaagttgtaccttaaattttgcagagaattcacacacgtttttagttttaaaactgtgctttttactcctgtttaatgttttgttgtaaatttatctgaattgtgaatcagctttaagttttttatgaaagaaggctgttttaaaaaagaaaagccaaatcagaataatttatgctttgcagaaaagaaaaagcacagactttgaacaatgcagttaatatttctggtactttggttaaaacataagttaagtttttctttgtgatcaatacttgcctatctatcctatttctccatctgaatattgcctgttttacaacaccactgtcatgatgctatccatttgttatctatcgaagcctgtgtagagttggaaaagtattcatagggatttcagattgcacatccctgctacacccttagtttcatctgcttcttttattttgtttgtgttttagttgttttcttttttacttttttttctctcaaaagggattattattttcacccctggtttgcttatttcacttcagtaatgcttatttttcttttaaaaagtaaataactatttgacaacttgttcattgatttatgaactatgtttgcaggggtttccctgtgtggttgcgtgatatccctggtattgaatttcgaacaaacaatgcacctttcaaggtgaaatcctttgttggttggcattactgtcttttatgtttgttttgtaaacagatctatatcatttgtttatgcttatttgtgattattccatttattcagtgttctcagttttgaactacaattgacatggcaaacgcttgttcttggttgcactcattactttatgcagggaattatgtcaaatttcccccttttttgtgtttttttatatcacgtaatgcccctcaatgtttgagggcaggggtgggattttttgaactgtcccaaaatcatagaataaatgataatgtgctcttaacatcctattttttttaaaaaaaaatccaggaggagatgaagcgctttgtctccaaggtggtgaatctgatgagagaggaaaggctgttttcttggcaaggtggtcccataattttgttgcaggtaggaaaagagtgtgggttttgggctttatatgcattaaagccattaattggttttacttttcataatttgaagcatattcatagtcctgccggggtatccaaaattagcagtgaaattacaactgtctctatactgttgtttgccttattgaacttgtgcttctctgcctaggtaacttttatttttggcaggagtgaactgcttataccagattatggataactggatataacacattctctggatttttctctaatttcaatgtctattggaatcacctaatgttatataatgtgtgtgatatacgcatgctagtaaagataggtcttaggtattagctcccacatatattaatagaatgtgtgtgatatactgcatgtaagattttagttgttgattcttgttatatgtttcattttttgtattgatgtattctgattataatatccaatattcaaattacttagttctccacctcatcagcagacttaattattttgtgttagataattgttgattatgctttattctgttatcttggaattagtgcatgcaagtttttaatttgatgcttccctttctagaatgcaatgtttaactaagcttgtgactgaattttatcagattgagaatgaatatgggaacattgagaattcctatggtaaaggaggtaaagagtatatgaaatgggcggctaagatggctctaagtcttggtgctggggttccatgggtcatgtgtagacagcaggatgctccatatgacattgtaaattatatccctttccactattaaaaagaactgttattggcattacctgtacttaataaaataaaaatgtgttcagttctctcttacagattttgaaaaaataacaaagggaaatgttaaaatatttcgtgattaaaataactaacaattcaagtggttaataaatcaatattgttgtacacagattgatacatgcaatgcatactactgtgatggatttaaaccaaactctcataacaaaccaacgatgtggacagagaactgggatggatggtatgaacaatcacatccttcaagggtacatgtgtgattatatagttaatgacaatataaatacaagtttaggagtcaatattatataaattgatcataaacctttcaggataaccaatatatttgtgttctgtgcttatgtgtgttattgcataaacctatgtctgttgaactgttgataagaaatagaagataagagaaataatgttctgagagttgattcattatttggctgtggtgataaatattttgattgcttccagttgacatttgaaggtatacacaatggggtgaaagattgcctcatagacctgttgaagaccttgcttttgcagttgcacgttttttccaacgtggaggaagctttcaaaactattacatggtatgatagttgaagtttttttttatttgtatttttggcctaacagttcacttttggcttctttgctattctaagctaatggttatctcatggaggattcttgtccaatgtctgtattggatggctttattatactgctgtacttttgccatattttgttctgtattgccatgcttttgttttactatttccctgtcttttattaataaaattgctttttattttaaatatccaattgaaactctactgtaagatgtgaatggccattaccggtttagaagcataaaagatctctgtcttgatactgaaaatgcagaataaaagcatattaaaaattgaacaggaaaaatttggataggtagaaacaaatataggattcaatggagggatgcctttgagaggtaatatacaacagctgagtaaatacatcctcacaggatgggaaaatggaagtagtttgatctatgcctttattagcaattgtttagaatcattttctatactgccttaggtagccatcaatagatgtggaacttgtataggggactgctgaaaaaatagaaaaattatacagtgagggaaggcctcttgaaaagatgaaccccttatgtaatgttcctctcaaaatctaattcaagaaccattgcccagttttaaagtgactgggaaagtgaaggaatatatattaataaacattactaaggtctttatgccattgatgctttaaatgtcttattttgctttttcattctataggatgccttgtcctttgttttgtacttccatttatttgtttctggtaatttattttcaatgaaaaataaacttaaaagtcagtgaggtgatatcttctaattgccacttttctttatatattttagaattatttaggatgaatatatatgtattatacaaggttttatctatatctgatgtatattttagtctttgagtatctgtaacccagatcttgacaagcccttttatgttacagtattttggcggaacaaattttggccgcactgcagggggacccttgcaaattacaagttatgattatgatgctccaattgatgagtatggtatgtagaagaataacaataagactgttgtttagatggtagctaatgggattcatataggctatagcagttgacatgattgatgacactcgatgaaccttgtttttctaggtctgctgcgtgaaccaaaatggggtcacttgaaagatttacatgctgctttgaagctttgtgagcctgccctggtggccactgattcaccaacatatataaaattgggtccaaagcaggaggtatgagcctaggctgaaatagatatttcataaaaatttcaagcattatggcttattacatttaatattttattggtagttacagtcagagacctactctcctaaagcttaagctattaggtaatatgtcaccaatggcttatatctctactactaagtcttttgatgcaagtacctttgggtttgaagtgtatacaatgcataggccactttaccttctgctaaaattcaacttataagagtctcaaagatagaagtcctgatcatctggtcatacagtctctcattctcatagcatattatgaatcaactctcctaaaagcttaaattattaggagaaggcgcatggatttttttacatctcagcagtcaccttgattttctgatctctgcgcttctttctataaaattgtcggttcctgttttctgatcttatccaaatggccatggcttggggttcaatccttgaagggtcatttgaggtgccctccaaacctgaaataacaattcaaccatctgtggttcatacctgacactcattctctccaaataactgcaacagaaaaacccaaaagtccaatttccccacctcaacccaaagcattttctccaaaatcataagctttctcaaatctaacttaaaaacccagcttcgtttcctctggactctagcatcatctagtacccttttagcaatgaaagcattaccaataatttttctactagtaataaaagataaaatgattctcagaaatggcgtctgaaagggcttcattcaatctggaagcaagtactcttgtgtgagttgtatctatcctataaacactagaaaccgagttaatgttgaaaaaaatccttaactttgactgacctatcctttttatttgggttcatacaaattccttctattggggttctgagagattttggggttatgctggaccaaaaggcaaaacccaaagactgtgagcagaagcaggattgtaatctgttaaatcctttattgattttcagttttgcactcagctagctcatatttatatacataaaataatgaatgcatcttatatttacaattcaagaactataattaggaatagaactgttccctatgatcctagtgatcccaacaatatcctactcctattatttccaaacttattactgttatcattcctcttagaatgtgggtttgaccctaactcaaccccaaaagctaattcataggatgagggcttccccccacttatacactctatattggccttatctctagccaatgtgggacttggatttctccaaataattccaaacatttacatgcaatcttcttgtggtgaaatagatattatatattttaccttgtgagaatagttgtgtatatttatctactttgattaatacattatgtcttcacaagaacatgtagccaatcctactttgtgggataggtatggaaaaatatatgggtgactttttatttttttctgaatcacatttgttcatcaatttcaggcacatgtgtaccaagcaaatgttcaccttgaagggttaaacttgtctatgtttgaatcttcaagcatatgctcagcatttcttgccaacattgatgaatggaaagaggcaactgtgacctttcgcggtcaaagatacactataccaccatggtctgtgagtgttttgccagattgcagaaatacagttttcaatactgccaaggttggtctatgctatggatcattttattgaacattttttgtttcttttgcctcttttgttgaattgagtcaacctcccccccccccccctccttttttggtgtaatgatgtacaatctttgttttttagctgatggttcttttggggggatctccttgatgaattatagagtgatttgacagaacctttgattaaataaattttagtattacctttgtgcttggttgtttgcattttggctgttaaagtgaaatccttgttgtctattctttttgcaaggtgtacatctccttgctagacttgtagtaatgttatattatttttgaggttgtctgaaactttctttcttctttatatttgtgcaggttagagcacaaacttctgtcaaactggtagagtcttatttgccaactgtctctaatattttcccagcccagcaattgaggcaccagaatgacttttactacatctcaaagtcttggatgactacaaaagagccactcaatatatggagtaagagcagtttcactgtagaaggtatatgggagcacttaaatgttacaaaggatcaatctgattacctttggtattcaaccaggtaattatgcacttctaaatactccgcagtggtaccaggtgtcacaagatattttgtggcttgttttacttttaatttctgatatatgtggtgtgttgtatcatgccttacttttataaaaaaaataaaaatgcatgcttttattgatgtttacagagagaatttagaaggaaaaaaaactgtattattgatgatactaaaaaatgaatgtcttgcatctaaatgaagagatacagaaggtatttataagcacctagatacagctgtcatagtgacagctgtatctaggtatttatagtgacagctgtatcactgactttgtaacaacctaaccatccgaacagttctctgtaccataatcagttactcacagctttacttgtcatctgtcttcttttagataaagagtaattcattatagctctaggtttcagggaccaactttcttttaaagcttaagcttttaggtgaaaggtcacagtgttgaagtgtggtttgtgtgggcaatgcacaggcccacacttccatcttaaatttaactttttctattacagtgacaagcaccgaactacttggtcatagaatgttacaatgttaaggaccaactttgctaaaagcttgagataggtgaaggctaatgaatgtttttatatctatcaaaaggaacatgaaagattacgtataagatatcctccatatcaaaattaaaaagaaaagatataagatgcatcaaaagacatcaaaactcaaaactaaagagcacgacagttttccctttgtatatcttccaaaggaattccgcagcagaaaccatgttctgaattccataatgctgcaatgaaattaaaaaacatcctcaaaatttcttttaaatattgattcaatggttgtctaattgaatatccattaatttgtgtgtataatgcagagtatatgtttcagatagtgacatcttgttttgggaggaaaatgatgtccatccaaaacttactatagatggtgtccgtgacatattgcgtgtattcatcaatggccagcttataggtaattgatctgatagtgttatatgtatgctgtatttgaatacgagcaagcaagtttctattttttttccttaagttaatggaagttctattatgaataacgtgcgctccactttattatgtagttaccctagctagactctttaacattctgcattttctgcttgaagttcagtaatgcttaagaaaatagaacttgtgaggagttattaagattaacttggtggttgagaaggagagtttaagggttgaagggaggaggaggaggagggggagaggtcgtgggtttaaatcctcccactaacattctaacaaaaactagccactaaattgtctgacaaaaaaaatagcacttgtgatctatgatagtgtttgtatgacaattgggagtgaaaacttggttgtcacagcccagatgataaattttcaggagtaggtagtgtccttgtctgtttaaagcactatccctaactccagacaatgggtccccttttttttcaaatcaaaacatcagttatatcataattcttgtgctttagaggtttaatatttatttcttttgtctacatatttataatcatatagtttcatttcttttccaagtgaaggtaatgttgttggtcattggatcaaggtggtccagactcttcaatttctcccaggatacaatgatttaacactgttaactcaaacagtgggtttacaggtgaaattcctagtatatttttaacatgtttccttatatataatgccaaaaccttaaattatttacagtcgctaatttgtgtgtactgtgttgtgtaggtatttggcaattgtgtaaaatttcataattctactgttatggtctttgaccaatcaaatttggttgtgaaactagttcctttagataagaggtttattagtaacagcaaaggaagaattgaagaacgtaatgtcaattattttgcctacataatgtttttcttatataataaataatttaatgtcttggaacatggaagttactgctacgtgttagtatggcagtttcttatgtttgaataattctataactgctttttcttaggatgagcaatttaaagcagttatttctgtaagtattggaaaaaacgactgtaccgcaggctctataaatgtaagaactaaacacccagttcatcaaaatatcaactaaacagattcttagaaactctggttttttactttcaatttcttacattttcctttttttattagtagtataaaatattaaccgcgtctattagtccattatttcattgcagtttattaaaatttgtatttagggcttaactccaccccacaaaactggcttgaaaggcaaggattgcccaaattttataagcattacttgagccttatttctgttgatgtgggactatatccacccctcgcctatcacaatgaaggtgcatgagaccgcaaattaaggcagaccaagggtgtccgcatctaaggcaactttccaacacagttgttaattgatacccatataattaaatgattttctttatctgcatacccgttcattagtgaattgatgacaaacgattacccaatgtgttcacattaatattaacagcatattcctttccatctgtatgctttgtgacttttatatctattttcttatatttctttcaacttactctcctatcaaacagttgagggataaagattactgactatacatatattttcatttgaaacaatgttacagaattatggcgcttttcttgagaaggatggagcagggattagaggtaaaataaagatcactggatttgaaaatggagatatagatctttcaaaatcattatggacctatcaggtatgtatttaatatttaaaccctaaattgatccaaaagaactgtaatttattagctggtttttagaggaaaatactattagatgtagtagactacagatatattctgtaaatctgtacagttagtaaaaatacagtaaatacacaagccaaatgcacgtgttttctctttctctcatttcctacatggtaccttctggaatctggacatattacaattggtcttcttctgaattcaaatgaccatctagcaaacattttctagggtgagtcaattagttagtccatacatagtgtaagtactaggtgtacataagctgtttaggtatactccagttgcattctcttcgtaaataaaccagtgtagttagtataaatattgtaagtacttaagccaaacatttgtgtattttcattcaataggttctctcattctctctattgtgtgtgtgtgtgtgtgtgtgtgtgtgtgtgttctgtgatatggattcttatttctggtattttggctctttaacctttaaaataattagggtaagcaacaaagaacacatttcagtttattgtaataaaaaataaaccacttatgtagaagcaaataagaactgcaaaaggatgagtgcagtaattattgattatatgtaatccaatcagggtttggttttgctatttgggaattcatgctttagatgtttaggtcttagtgtcttacaatatctataagcaaatgagaaaggaatttttttctcaatatgcttgagtgttttttccacccagcagattgggcttatttatattcaagagtatttcaaagacaattaacgcccaaacaatttaccagagaacaatgaagataccactacttcctaagatgcattgaacctagctataccagaaaaattctgatggcaggcagaaaaattgctgtaagagttctgatagtgggcagaaaagtcatcgtaaattctgacaatcactggaaatgttgctggacaattctagaatttttggatgtctgacagcttcaagagcccaatcagacggagaccattttttttgcagaaacaccccctccccccagattaggatctttaataccatgtgagaaaatggggggaaaaaatctcaatgtgcttgagtttgttttctttccagcagaatgaacttatttatgttcaagagtattacaaagataattaataccaaaacaatttacaagagaatagttaagatatcactacttcctttttattttaaaggaggcatccactacttcctaagatgcattgaacctacgtataccaagtacctaggctacttgctaaaataaacataaaaaatgctcttatctcctaaaatattcctaattccaacaatatcttaccttagtataaattggattgagattctatgttcctgtatgaaataggcttttgaatcttaagtttgggttacatgcccttgtaggaataggttgtttaagttgcttatttgagatttttttatgtcaaccttgacatggtaattaaaagatataaatttgaaaggaaaaaaaaatcttggttttgattctttgttcaacatcagttggtctagttctgccttcactccaaagaaacttaaaatgctgctttaatggcgtgttttcttggtgtgtctcagcttcattatatttattctaagtttatttgcttgttctataattttcatcttcatgtcatcactttctatacttgtgggattgtacttttcttagtccgaggaatttgaaaatactaactccactttattcatttgtatcccaggttgggcttcagggtgagtttttaaaattttacagtgaagagaatgaaaattcagaatgggtagagttgacccctgatgccatcccatccacatttacatggtacaaggtaactatgagctgttgaagtgatatatgagactgctttttacttatccatgaaattaactcaggatcaagaaacaagcaccatttaagattaaaaaatttcctacagtggacaaattcatgaataatagaaagagtgtacggtcaatgaaaaagatgattataaatttatgcacatgctgaattcctttaaggaaagcagatgatttggaatgaatattttatatatgcccaggacatttgtttgttctctgtgttgcctctgaaattgttcaattatctatttattgtaattaactaattattatgcccaacgcactgccacagagtgagtgaatctataatcatatcacgactgagatttcatgaaggtgctattaagcccactgatcattctttcccaatgctatttttcttttttatcacaacagaacaaagtataaataacacctatttgtttaaagcagacatattttgatgtccctggtggcatagatccggttgctctagacttcaaaagcatgggaaaaggtcaggcttgggtgaatggtcaacatataggaagatactggactcgggtttccccaaaaagtggatgtcaacaagtctgtgattatcgtggagcatataattccgacaagtgttcaacaaattgtggaaaaccaacccaaaccttgtatgtagtctcaaagtagctaaaactgttggtttcatgatttcatgactccaaaagactttatcgattaattatgaaaagtcactcaaagcatcatttatctcctgttgacttacacctttatgtacaatattttagttgaaaaactttaaattatcctaaccctaataatcctattaattaccaaatgaggaaaatattgaatttttttatattcctattatattaaatacatcagctttttaatttaatactttccttataaagtattggaagaattattgtaaagattttttaggagaaatcagcattacttattgtactatcatacttatcattgcactttccttaacttgagttattggtcaatctccaggtaccatgtgccacgatcatggttgaaagcaaccaacaatttacttgttatcttagaggaaaccggaggaaatccctttgaaatttcagttaagttacattcgtccagaataatatgtgctcaagtgtcagaatccaactatccacctttgcaaaagttggtgaatgcagatctcattggtgaagaagtttcggcaaataatatgatacctgaactgcacttacattgtcaacaaggacacacaatttcctccgtagcatttgcaagctttggtactccaggaggtagttgtcagaatttttctagaggaaactgccatgcacctagttcaatgtcgatagtttctgaggtaaactctatattgggtagcttttcactcttaactattaccttaggggaaaagaattgtggacatagttctctgcaagaaagcaaaagctccacatgattttggcattgtggacttagataaaagtgatgatgcaagacattttccaaaatgcttatactttaagtattacgattacaaatttattgttatcactgaataaacatttctgtaggcactagaaaattgatgagaacttgtatgttaagaaaagtgtaaggtcttggctaatgttgatatgtagcatggaagaaacagggctgtagtgttttgcggctttttagctgcaggcttttaatgttttgatgaaaaatattatgtggtgagcatggagatgctccatactaatacatgtctgtatcaggcgtaacagttgtgggcatggttgacaaaacctaacttttctagtgccaaaattagtgtggccattctaagtgatcttgttgttgaccctcttcatatatacttttttatattttgcaggcttgccaagggaaaaggagctgctccatcaaaatctcagacagtgcattcggggtagacccgtgtccgggtgtggtgaaaacattgtcagtggaagcaagatgcacatcaccattgagtgatgacttctttcaagaggctgttagcagcttctaaaatgaggttcggtatgaaccttgtgaacacaagccaaccaactggacaatgttactaaccagaaatggccattaattgtgttcactcgattgtgtatatataaatgtcatgatttagtgcataagacttggtcttttgacattgaacagcaaataagtaatctctgctgatcaatgattctcctttgtgcatgcaataccatgggttctttgatctgatgatccgttgtgggctaatgctgatgaaggttgcataatcagcacctctttcaatgtacaagatctttgaaacaacgaaggattcccgaagcaataaaaaaaccgagcaattttaaaaagttatatctactttaatttttaattagttgataatgtaattttttacactatatatcagctaattgtatatagaaattaaactaaaatttcaaaacttccatacccaacacgtacattacatttgcatataaaaataatagcatttattggtgtcgtcccaaaaactcaaactatcattacaagtaacaaaaataggtttctcatacaaatcgttttgaaaatgtataaatttaagaatttattttttatgcatcgtcttttagtttaaattttaaaatgtttacattgttaactaattaaattttaaaatgtttacattgttaactaattaaatttttataattaatgtagcttttgaaacaattattacaaaatccaatatatcatacgtgatttctaataatataagtagatgacagtgagtatttaaaactataaataatttattctaaatattcataaaatgtttttcatattgataatcgcgaaatttgatttaatttatagtcaattttgattaagaatgattgtaatttatttactttactgttgtttttaatgaaataataaataaattaatttctttgcagttttttattagcagaagttaaaagaaaaagatttcaagtgctttaaaaaaaaattaaagtaaaaattggaagaaaaacctaaagaaaaattagaagaattggacagtccgtttaacgcataagacaggcacaccgcgcactctcgctcagcgtgcaacacacgcttagcgcggaaaagacacacgaaaaaagtcccaaggcgcgcttagcgcgaagaatccacacgaagtgcgcccccacactaagtgtcaggtctcatgaaaaattaagctaccttaggcttataaaggagtaggaaacagaagggaaggacacaaaatccacacactgggtctatcccttaggggaaatcctctctctttagtcatttccccttttcttgttaccagtcatccatcatcttctttcatccacatcaaccctctaaagtgtaaaagtctctcatgataatgaaaggttaaaccccccttagttagggcctaacaggcctaaaaagacaacagatgtattgtaatgtttcatatctatcaatgcaatcaagtattttctttcctattatcatttcttattttaatttcatgtatcattcattcttgcatcatctttaggggataatagaaatataattaaggtcttacatgcattagttttagggattagtcgcttgagagacaataatttctaatagaactcaaagggaagagttatcttaataaaattattgctagacatagtgattgcattatgtccatgcattaaagcaaacatctagaattagaacttcatgcactttatctattaaatctttgcaaaagtatttgggagatagatagataagataggtttgtcgtgattttcagggacaagtattccaatagatgtcggtagaaaaaaatcatcaaattgataaagaaaaatctaaaatcatacatcttagacaaataacgcatgtttgcattctaatttcatcttttcacatttaaattgttatttgtttttcctgttatctttttcatcttttcacatttaaattgttatttgtttttcatattatcttttttctttgtcttactctaaatttcacacttataattctttgtttgtctttcttcttattgcttaaaagtcctttcatgtgaatttgataactttcattttaatttttactacttatgataaaattgatacacttgccaattagttaaaaaaagtttttggcattgttgctagaaactttggttttcatactaattgtttacatatcccaatttgagaacaattatttttttattattttattattttatttaaattctgttttatctattaatttactctaaatattcataaaatgctttttatatcatacatcaaatttttaagtacttccaatataatgctttttcataaaatgaaaaatttaagaactaaatttaaaaatcatcaggacgtaaactctccggtcttcatagcaaaccagattttccaatagttgtccaaaggcaatttcctataaaatctaagtaaatgacctaaacatctccttgagttgcaaatacttaccatactaattttgttcatatacacggacaagcttttaaactattttcaggaaggataaatttagatcttccttcaagatctttctacaaatccttctatttactaaatgcgaaagagttaaatgcatttatatttccaaaatattaaatgcattcactattttacttaatactatataaagtattaagaggattagtaagataaagaaaatagcattacacttccaagaattctaaaaagtttccagtaaaagttatttaattctagccaaacaaatcttaacgaaaaaaaattcctacgggatagtattaacagcgaattattccagggaatgttatccataagaccataacccttaaacgttgaagcaaacaaccatatgaaataaagggtgaatgcgctacaatattatcacacgtcatttatactcactcaaccagtaatccgcatatcaatgacaaacctttggctgaaatcacttccgcatttgagatagcaagcattcacatcacacatacgaagagtatcatgctcataacgatagcaaggaaggagagcaagtttcactttaaacgtctgatcttttttgtcgcattgataatgttttgacctatctccgggtgtttgaactccaacaatttatcaagtttaagagaagcttcggagaaacagctatcctcaatacaggactcagatttgagggcaaaatgaacctcattgacgtcctcgtcaagctggaggcagaagaggtggctgaaaacctatgtaaagacaacagaatacatcagtgatattacagaataactttactctaaatacagtaaaagaaaaacataactttcagttgccaagacatggtttaaaatatcttccacaatcaacaaaaccaaaattaatgctgaataaatatttatgtacaacagcattcagggtatatattggttaaaattcaaaatttggagatcttttctttgaaaagttcaccagtttcagcaagaataagatgagtgaatttattttaagtgtgctgattgtgtattggagaacaatacctaaagcacctaagaaactgcatttaagttgtcaaaaagaaaagggagagggggaaaaaaagaataaagatgttgaacacatttgtaatgaatctctgattaaacaagatacagagtcagacattaaaaatcaaagtccaaactgaatattattgcactcatttgtttttacctttttcatttttgagagagccatatctttaatggcttgggaccgtgacaccaaattgacaacaaagagaccatcctctgaaagtctatcctttacagtctcaagaaaagactcatccaaaaaatccggagcagggcatgtcaatcccgagctgtacaaaatatgtaataaataagtaggattctttaaaatcatagaagatattattatttctaatcccttaatggcctaataccagtttttttcttggccattctataatagcttaatgtaataaccaaatgcataattcaatttaccttgggtctgaagagtcaacatcaacaataattatatcaacttttgtcacttctacatcagcatgagacacagctgaacttgcatttaaagcggtatctgtatagctaggatcattactttttccatgaatctgagctgctccagaactgtcaatctcccggacaaactggatcccatcagctatatgcacctgcatttcccaaaagtaaaaagattcaattgccaatgttgtgatcactccatcataagattaattcaacaaaattcttaaattatatggtggttcttagtattctgcacacagccttcacccctcccaacaaataaaaacggaagtcactttatctgtggttgccatatttttattgtcatccatattttaaactggtgtttaaaacagcaaaaaaatcatgaaatcaaaataattacttgcaagaatcaacattgtatgattcaagtaagaatggataatcttttcttaaaactagttactgttttgtgtagatatttccttttatgtaagttagcaatctggctttattttggttagtcctaatttagatttaaaccccacaacacctcaagagaatgacatgaatgtatatataacaacctttacatgtttatcctcaacaaaactgaagtagtcccttgcaatatcaacaatcatggggtctaactccacagtctgtagataaaaattattatcaagccatgtgatatcaatcattctgaaaaataaatcattagggactagctctgaactctaattattccccctccctatacaacacggggaaaaaatataaattacctcaatttccaaaaaggggatacatccgtgaagaaacatgggaagtaaacctgctccaagacctattattacagcttttacctgagatattgcacttgaatgtatcagcattcagcaataatgaatgaaagaatgtttaagagcgtatgaagaaagtgagacaagttaatttggcatgtatttacaatttcctattatttgaaactacagtccttaatgtacctagaaaatagtagattcatgcatcagattaaaagtcagagatacttgccattttcccacttgatgccacattttccatgtgagaagatattagcatgaatcctgaaataatccctgtatgataagaactagctacatagccatgatagacagtcaactgactgcttgctcctgcaacatcggaaaaaaatattacaatggcagttataaacagtgagcaaatattgcaaactagaaaatgaatagttttgaaactgcaaaaatcctctctctaatactgctgttaaaccatttttaacatatcatattcatccaaaatcatttttaaacattaaggcttcaaaacaattggcaaatgatgaacacaaattagcactattttatgaaacaaacattaaacgtatatccatttaacagattgaaaaatatagtatattattatgaatttttttgccaataggttttacactaattgcatgtctacctttcacgtgatatttttcagaccatcacgagaaatgtctactttaacactataacaattgcaatcagagtatcagattaggacagaataattatagcaatgttttgaaaaaacacatctagatggtttaatatatattttccaaaagacctctcattggatacacattgatatagaagagatatccaatccagtactaaaatgtttgtccaatcatcagtgtcaaatgatgcatggcaaggaagtatgcacaactatatagatacacaaacactgtctacaatttttttaataaaagaaaataatttagcaaaatgaagggaaaattacaagaggtcattcctcttaggccttgttacatttacattgaaaatcaatttcacacaccatgcacacattccaatgtaaaatctacagctaagattaatttggacacacatctcaatcacgttcaacagttcaaaaccaattctaccaaaatataaaataaatggacactttatgatatacaacaatagattaacaaactcggaatttgacaataatgttgaagcaacagttgcaggagttgcatcagcaatattgaacagtaatttttaataaaccggaggcaagaggaaaataattaccaacactgtctctccaagatccacttttcctagatttggaagatgcattgtttttcttcttccctgtctcactaaccaatttggtaggcaactgttcatcttttagcaaagcttcagactgcaccaaatttgcagctctctcgaatacaaggcgtcgaaacatcaactctccagaaggaaaaatacaactgacttcactatcaacattttcataaattacatcttcaacaataattgatccagttaatgaagatgtgacctgcaaaacacacataatcataaatgatataatgagaatgtggggatcattttaaatcaagcaagccatcacaagaatgagcatccatgtaaaaagtaggagcacaaaagcaaaaagactagagaataaataccttttatttcttattgataaaagcagcatttcaaaaaacttaatagaatgaagaggtaaaattactcttagatcaatcaagcaggtgtataaaaagtaaaaagaaaaataataagaaatgagcccagtagggccccaactccatctaatgaacaatggaaaatcataaaaagaagattggtaagcagttaatctcacagccttaatagacagagagagttcaatagataaaaataacaaaacagacacagtttatcaattatgtatattgttacaaaccttatgaatgatgtttcgctccttgatcccctcacttgccatcatgaaactgtaggcattgtattcaagaatttgtgagaaaaactgaaattcatttattgtttaatgtgtgtttggttcagcttattttgaagaaataatagcctatatttgccaacttctagagagagattttgacaaaaaaaaaaaaagattacttccaggaaataatctgaaccaaacatgctataagtatgacaacacctgaaaaaaatggtttacagtatattaattactgtaaagcataatggaacatgtttgaatgttttgcatgaatagaaaaacggagaaaaaaaatgaacatttatgttaaggttgctcaaaataaatgaaaaatcacaaaaatgcaactggtacaagatacagacggtattttagctccattcccattttctgcaggtgccaactgtgtaaccaacggagacaaatccttctgaaaagggataacggacacaattcagtaaaaagcaacacaattaacctgttataatggcatgtccatgaagcataacttatgaggatgtttctacctgaatctcctccatgctggtatctgaatggctggcatccaagtaaacctaaagtcacagatttgcttggaagcttcaattacaaaagtaatttgacatactcaaaaataccagcaagttatacttttataaaattaatagcataccattatgagacgagctgctttggagcttctgaccaccatccactgtccttcttcagaatagaaaagccattcacgtgcacgagtctgagatttaacattcagtcatgaaattcaaacagaataactgcctaatttgatggcctaggtgtaaactgcagatagatatcaaaaaaggaaatctgaaatcctgtggaattagctctacaaatgcatattgatgcacatcgcaatccaaaaaaattaaaaaataaaataaaattagatgaaaaaaacaaataaagaaagaacttaagaaatactagaagctccatctatcagccaagtaacaacccggtatccctacctctaataaataaacaatctgatcctagatgcaccacggcatagaataactgaatatatattcaaaaacaaaacacttactttgatcattttcagtatgaacaaggttgagactactaagaatagaaattaaaaagaatcagaaattttgaaaataacaagtatccaattgtccattgtccttcctagtttcaaaaagcattgtcagcagcagattctagtcaaaagcaaattagcaatggttctttttgttccgataataaatatttcccatttattcatttgttaaaactactgtgcatgaatctcaagagaaggatcactaattcattctaaaattcaagagcattaacaagaattttttctcttgatatgaagttagaaagaatgcatgaacaaaaacctaaagggatctctgctaaagcacaccttaggcacaatgaaaaccccacagtgataggtaaatgggtcagcctgttcctcagcatcaagaattacagctctgtaagaaaaagtggagtacccttgtccccccaaagttagctgcaatcgtcgaccttgagaaagctttgtcaactcctcttgcagatcttccacagaatataatatatcagagccactggagtatttttcacgaatttgattctcattttgaagagcctcgtggagtccagaaaccttgcacaattgggggggggggggggggggggggagaacataaacagaagataataagacctgattctctatacaaataggcattagtacttcataactttaaaaactaccccttctctacaaccataacatttaacaccctacagtaatactatctatatcactaacaataacaaatgtagcattaatcatccatagatccttattataagaaaactcttatgcccatgagaactgaacaaaaagtagaaatagcccagatattctacctgttttgaattactatgaagtgaagaattatggagcaatgatgtaatctgatgcactaaagtagacagctccttctccacaacaaccataaacgtttgaaggctaggtttaccagaagactttaaaggtatggcatcaacactcattttccacccaagtcgaaactttgagaaaagtagatctggatattgcgaattagcgatatttatcctctagtcataccaaaccaagcacgtcaaaaaatggaaaagataaaatgcaaaaacagttcaagaaaatcatttcattgcaatgcaaagtaacaaagcaccctgtctaagtgcaatacgattaactcttaaggtaacgatagcttcttgatagcatgttattattattatgtaataataacatgctttttggtcattattcatggtggaacaaaaataaggaaacttacttagtacatgagattcagccaaggtaaggcacacaaacttgcccccaggctttaaaactctcttcacctgaaaataaaaaataaaataaaataaaaaataaaaaagccaagttaccaaaaatacaaaatagtcaatccatataaacattcattatttagatcttgtttgtataaacttctatataaaaacttttagggggaagtaaaaagtaaaatacattgagcttctcttataagttaaaagcaggctagacagatttctattatcaccggattggatgactagatggcctgatactactcaaagcattttggacagaaatttctctgaccattgtccaatcattctcagatcgaaagtcattgattggggacccaaacctttccgggttcttgattgttggctgttagacaaaacctttaaggacgtggtcaatgaatgttggacatcaggtcatcaaagtggatggggaggctttgtacttaaagaaaaaataaaaagactgaaaagtagattgaaggtatggaataaagagcaatatggggatacattcaagaaggtaaagcagctggaagaggagttaaacagacttgaacaggcgacaatggacagacagctttcatcacaagaaatgatgaccaggcggcagctacaggaagacttgtgggtggctgcccactcacatgaatccttacttaggcaaaagtctcgctctaggtggatcaaagaagatgactgcaactcaagatattttcatctcatgatgaacgcgtctcgaagacaaaatctgctcaaaggcatcatgcttgaaggttcatgggtgactgaaccccaaagggtgaaggaggcagttagagaatttttccagcaaagatttaatgaacctgagcctatcagaccaactcttgagggaattccatttctgaaaatcaatcagcagcagaatgctatgttggttggcagatttgaggaggaggaagtgagaaaagcaatttgggactgtggaagtgataaaagtccgggcccggatggtctaaacttcaagttcattaagaagttttggaaaatcatcaagcccgacatcctccggttccttgatgagttttatgtgaatggtatctttccgaagggtggtaatgcttcattcatagctttaatacctaaggtgcctgatccacaacagctgtcggaatacagacctatttcgttaataggatgtatttacaagattgttagtaagatcttagctagaagattaaagaaggtgatgccatctattattgacgaaagacagtctgcttttattgaaggcagacacttattacatggtgtccttgtagcaaatgaggtggtggaggaagctaagagaaagcaaaagtcatgcattgtgttcaaggtagattacgaaaaggcctatgattccgtgtcatggcagtttttaatctacatgatgagaaggatggatttcaaccagtgttgttaaatggcggccatggcggcgccatggcggattttcatggcggttttttgaaaaaacgccaccgaatagcggtggcgtggcgggtttgggatggcggtcgtggcggttatggcggggtggcggaaaatggcgtccctcccgcaccccacacgcgcacccagccgcgacactcgcagccgcacgagcacacagccgcgacgacctctggcagcgacgcaccggcacaaacggcggcgacgagctccggcagcgacgcatctgtcacgaacgacggcctgcagcgaggagttctcgcagagaagacgaagctgctgtcgcgaagaagaagaaggcgtcgcgaggaagaagaaggcgtaggttttagttttatttttgctgtttgacaccccctgttttctgtctgcagctttttttccttttgctatttgacacccctttttacttttaacagtcccatttttttttcgtatttgacaccacaattttttttttctgttcagtcctcttttaaatggctgagtttatttgaactctttaatgagtttatttggtgttggtacttgattattgtatgaactcatgaaacttttttagtttatttgaatgcaatcctttgtttttttcaatttcaatgagattatatatatgtttttttttttttggtccgccatgacatccgccattttccgctacgccatccgccatatttttatggcggattttttactttccgccatgaaccgccatccgccattaacaacattgatttcaaccctagatggattatgtggattgaaggatgtctagcctctgcatctatctccattctcgtaaatgggagcccgaccaaagagttttccccctatagaggccttaggcaaggggacccccttgcgcctttcctattcaatattgtagcagaaggcctaaatgggctgatgaaggaagccattgagagaaaaatctacacaagtttttctgtggggagagataaggtggatgttaatatcctacagtacgcggacgataccatcttctttggagaggcgacaatggagaacattaaagcaatcaagatcatattgagggctttcgaaatggtgtcagggctaaaaattaattttgccaaaagtagctttggatctattggcatgcctgatgtgtggaagcaatccgcagctgattacttaaattgtagcttattggccaccccttttgtttatctggggattccgataggggcaaacccgagaaagagtcagatgtgggaactaattatccacaagtgtgagaggagactagcaaaatggaaacaaaggcatatctcattgggggggagagtcactcttattcagtcaatactaacctctattccaatctatttttttatcatttttcaggattcctagaagggtggcagataggctggtcagcatacaacgaaggtttctttggggtgccggagaagaccaacataagattgcttgggtcaagtgggacgacgtatgtctaccgaagaacaaaggaggcttgggaataatggacatcacaaaattcaatcttgcgttacttgctaaatggaagtggaacttattctaccacaatggagagttatgggcaaggattctggattcaaagtatggaggttggaggggtcttgatgcagcaacgaatgataataacgcctcactatggtgggcagatcttaaattagcccttcataatccccaacatgagatggtgttaaagggagggctaacatggaaggtggggaatggagccaaaatcaagttttgggaggatgattggagctttggagacacaccgctgctggcaaaataccccagtctgtacctaatttcagaccaacagcacaactatattcaggagatgggtcagcaaacggacaaagggtgggagtggaaatttaaatggagaagacacttgtttgacagagagcttgagatggcagattgcttccttactgatgttgctggcagctgtatccagattcacaaaaaagatgagtggatctggaaaacagagcctactggacaatattcggtaagaagagcctataatatgctcaatggagtggatgttgggaggataatgtgtgggtgtttgaggagttatggaagattcgagtcccaactaaaatcactatttttgcatggaggttattaaaggagagactacaaacgaaggcaaatttgaggaggagaagggtggcaatcaatgacacattatgcccattttgtggtaattctgaggagaatgaagcgcatgtatttttgacatgtgacagaatactcccattatggtgggaatctatgacatgggtgaaggagcttttccgcagaaaccgtggcagcacttttcccagcatgcattctgtttacatagcagaattcgtcttaaccgatggagaagttggtggttggccctcacatggacagtgtggcagcaccggaataaaatcatcttctcaaatgaaacttttgatggtaacaaattaatggaggatgctatttttacattatggacatggctgaagaactttgagaaagactttgctctcacctacagctattggtcgtctaacatagcatcaggatttgtattttcaggggggtagaaatcatagacggtgggtgttgtaggtctttgtaatacctagctttggttccttgcgagactgatcttagtctgagcttggaaccatgttgctggcaagctaatctaattacatgtactgttttgtacctctggtactcacaatatatataatataatttatctttgctgatcaaaaaaaaaaaaaaaagttaaaataaacttatgctccttaactttcataaaagttctccaaaacttaacatgcataagcttttttttttttgttatcatgttatcggtatggaggatgcaccagctttgccaatgactaatttttatcggaaacctggctggccaactgtagtggggttctccctcccaactacgttttttccatctacaagggttgaaccctatagcttgtttaaggaaaccgagtctagtcccactcggacgaacgagttgttggttaacatgcataagttaatttcaacttaggaagttacataattttttttttcttgtcttaaaactgctaatagataagttcatccaagcatgaactaattgaattaacaaaatagagaaaccacatacctctgataggtactggttccccaatttggggccaagctcgggctccatcaaagcatcgagtccacctttgtcaatgaccgcaccgaagctctcgtcctcgaactgcatgacggtcatgtccataacgcgccatcgcatgagggggcggtcgcggacgttgcggcggagcatgtctccgatgacgaccttggagaagtcgatgttggtgatggcggtgtggccggcgtcgtagaggtgctcggagaggcgggagttgccgcagccggggacgaggagctgaagcgggagagggagagggatggttttgaggagggagaggagtgggtccctgagatggggccattcggcgtaccactcgaaggaatcgccgcggagggtgaagaagttgtcccagttctctttgctcgtgaagtctcctagggtttccagaatgtcctccggtgaacccttcttcttcgccttggaacccatttcttcttcgccttctttgcttccactctcactcacttcttcacaaacaaaactcttttatactgcgcttcgcttcacttcactgtcttctagtcaagacaacttaactttaggctaaaccctcctaatctcagatattttaggaaaatcacaacggctcactcaataatcaaaaaatctctccaccacaattaattattttttactcacctttaatctctcattattaaattaaacatttcagtaattacatgatactattaactgtttttgtgagtagtatttaaccgcattagaacatttgtagcgctaaatcgtttgttgagttgcctaagcggatatattcaattagaattttgatagattaatttaatattttcttttataaaataaatattgtgatattgttgaaataataaaaataatcttataaaattcaattaagtgaattttttatgatttttactcatcacgtctcatctattattttttctttctccaacatgatgagatatttaaatggattcaaatgttcaatcaaaattatttattgaaagataatattttgtattgtaaaaaaaaattaactatgtgaaaacaaaatttgctaagcaacattacttaaataaataccaccaactcatttgtttcaattgtgcattattgattaactctaatgttttttttaaaataaaatcatagatatattagttgaaagtctatgagagtcctcaagttgaggataaactttctcaatccaaaccaaatcaagagtagaaaaaatagtctgagttagacgatccgaaacattaattttcgtttttctagtatgaactaacgaattgcatgttaggtttttcataaaaaagaatctcaaacaatcgttgagtaaaaagtttttaactttatttttcacaaatgcatgaaaatgcagacgtttaacttagtgttgaaccaaccacactcaaagtattgtaggaatttgttggactttgaaaaaaaaatcacaacaatacctcagcttactcttaaaaattaaaataaacaacaatgttgaaaatattcttacaaattagttttaccaaataatatacgtcccacgtgtcaataattatgtaaaagcaaaatttatttatttctaatcattataaaattaaaaaatttaccttttcctttaatactttatttataagatagtaaaaagttttgtaggaagacatagcaaaaggatatgacatcactctcaaccatggtatctaaagcaaaaattaatatcattaattatttgaaagacaatttaaataaaataattataatattaattaacattttttctcataatattaatgtaaaggatctattaactttaataataattaatcttcgcacttgtgggtaacaatttgaagacgatatgaaaaaaaaaatcatttaataaaacttttaattagggataattggttcgctttggcttgacctcggcacaaactaacagagcattagcatttctccttcgtatcactgccgcgacccttctggttctggattccgacggtgccattgacaaccaccaccgtaagtttacattttttttgttattattattgtttttcctctgttcaattggaatttgttcacccggatcctgcatcctctttactaagatgggtgcactgcaaaatttcattttaaatctttgattctaatatttctgattttgttgttggaatggaatagtttactggtaagatgggagagctggccactgagaaacatgttcgatatatattatcagttgaaaaggtgggtgtgcttcccatttatatatatatatacatacatacatacattctttctcaaaactcttctttaatgcttaaaaggttgtccttttatggtttccagaggaaagataactttgaatctgtagtaatggagcatctgagaatgaatggggcatactggggattgaccactctggatcttctaggaaagcttcattctgtcgatgttgatgaggttgtttcatggttgatgagttgtcagcatgagtcaggtggttcttcagtgttttatttattcccttaatttgagacatcggtgtcattgatagtttcttatgagaaatatgtgttgttgtgaagggggatttggtggaaatgttggacatgatccgcacatcctgtatacactaagtgctgtgcaggtgttggctctctttgataagctgaatgttattgatgtagataaggtcacaagttgtatccttacacacatattttgtgctgcagaagaagctttgttatttttgcaattttttacttattatagttctgttcttttatcaggatatgtaacttcagttggctatcatagtttgatgttatgattcaatggtttgatatgtttcttagaaagaaagaaaaaattgttgtaaattttagtacagtttgatactaaaactataatagtaaaatttataataaactagaaaatatactggatcttgtgttttcttactatttatgtcagacattgtcagcctgcaaaatgaagatggatccttttcaggggatatgtggggtgaagttgatacgcggtatttttcttaagatccttttttgttattgattatgtaagagcttactgtatttttaactaaaatccactgaattatttgtcttaggttctcatatattgctatttgttgtctatcaatattacattgcttggataaaatcaatgtggagaaggcagtgaagtacattataagttgcaaaaatatggatggtggttttggttgcactcctggtggggaatctcatgctggtcaaagtatgtcataaattattcatgatttttagtttgttattaatttccctacgttacttacccaatgtgtgtactaatacttttttccttcaaagattgtgttgcttctttcccacatgaagggagtgctttatgtggtgaagggcatagtttgaaattttaatatgttgcttaaattggtgggtacacaaatctgttttctccttggcagcacagtgtagctgatagcaataccacacagaggggtgcagatagcagccataggcccagaagagtgcagaagccacccacttaccttcaagactacgtctgatatcagcaacagaatcagaccagctttgccttgctattatcttgtcaggagtttgttatagctaataggataatttcacaaattctgttaatgatatttccattctgttatattcttgttaccccctctatcaagtgtatcagcccttataaataccatgaatgaatgaaataaagcaaggaaaaagtttatcagtatattcttatagcagtagcagtagaattagctaagtatagaagttcaccctatcagtagctatgtaacctagtacttacttacattatccaattacttggtagttttcctgatagaaatggtgtactttccttttgttcttttgcggtcaaaatttactcatgttaagactgaatttgtctgtttgatttttctattttctgaatttcaaatgggtagtggacttgattcatccttctaatatatttgcttttcctgttgtcagttttctgttgtgtgggggcccttgccataacagggtcactagatcttgttgacaaagacctacttggttggtggttatgcgagcgtcaggttaaatctggaggtctgaatgggcgtcctgagaaacttcctgatgtgagtgaatcttttcaaatttagattaagttccgtagattgtcctttctcttactgggttttagatcttctcaggtctgctactcatggtgggttctttctagcctgatcatgattgatagggttcattggatcagtaaggagaagcttataaagttcatcttagactgccaggttagttagttgaatgtctttttctgtgtttatctgcatgttcttttttctttttggggttttaattattgtcaggcagtatttctgaaatattatgtatgttgaaactgtaaggacacagaaaacggtggaatttcagacaggccagatgatgccgtggatgtctttcatacattcttcggggtggctggtagagtacttccatcattttgcctttttttgttccatttgttgtgctaattgctaaactcttgttatctggggtttccttggtttgtatgggaaccacccaacctctacctttcccatgactcaatgtgggaatgataagaatgtatgaaaaaccattctttttgaatccttgtggattcatgttgctaagttgctagcatcatgttcagaattcagataagattaatcatattgttcaacatgcttataatgattcattagatctggatatttaacatgattctatttttgttttagttgtttggaaggtttaagtgagcatatgtgtgaattataagctagacatccctatttatcctttcctaacagtgcctattgcttttattcatgtgtttcgtattccttttacactataaactagggacgcttaagttgtgttttttcttgcaggactttcacttcttgaatatccagggctgaaaccggtagatccagcgtatgctttacctgttgatgttgtaaatagaattttctttactaaagaaggacttaagtagttaagttcgatgataattttccagtaatgacaaaatcttgggtttgtaagactcactcttgggagttggaccccctcctcccatctccagtccaaaaacagttgatttcttaaaaacagtgtgaacattttgagcatcttttagttaaattgcagtgatacgacatgtaaagattgatcagtattgtagtcaaccatcaaatttatcttactagttactacatagcagtataatttcttttgttaagtatttaaaccttatttttcttatgaaaaagtgttacgtagacaaatttactattgcagtcttgcaatgggatagtttctgtaattctcaacttcatcattttgacacaacagaactttacataaacatcaaactgaacttaacaaaaataaagttcctaacaatacaacacaagcaaacataaaaagaatatctacattatttgtacaagtgaaaagagtaagtatgttgtttggctactagaattgccacctactatgatgtttcttttacttgttgctgcactaccaaaacacacgctctgctctgaaaatctgatgaagcaagcaaatcaccaatgacaccgaactctgaaaattcactccaagttgtaagcccaaccgtctgaggtgagtctaactcgtgtcttctcccaacaatgaaatagtgatgttcatttactattttgccgaagaagaaatgtctctggtccaccattcaccatgactttttgataacttacatttcccaagtgtggtttcataacatgttttagtgcctccttatcttgtatatactccacgtctggtgtttgttccttaggaactaggtggtacacaaccaagttgacccttggattccttgtaactcgtttggctaagcacaaagcctctcggtcatcgtttccacccagaaaaatcattgctacctgaatgaatgagtcacaatgaatggcagaacgaccaacaaggattccaactgagcatggagctatttctaaaagcttacaatttaaagccctcgcattcttgtaatcagattctatggcaccatcaccagaccatcttagatggaatggaagaattataatggatgccactttgtccaatgctaaatgacaaacatcctcatgcatcagggagggtggagatatggctgtgtaaacgtgtgcagttactgcacccatgttgtcatgttcatagaggtcaaaagcaagaatgatatcatctgaataagacttgtggttacttgattaaattgttctttgaaggcgatgggaaatgaaaatgggagaggccctgacaactagctcaattagatgcattgcatccacagttggggtcttctgttgttggacaacaaaggtcaaggcaatctttcacagcagatgcatggtgtgttttatgaaggcaagcaactactctcagctccgagtctggttttaaactcgctatgttccttttcgggtacccagcgtatttccttgatggatcatagattagtttcacagaccatttcactatgcttgcaatgaccattatgttgatcatcattactccataagtaggaccactaatagtctgcatgcacatataaatgaaattttatattgcattacatatagacagtgataagactttaaactgaagattatggctagttttaggataaattaaattttatcctttaatgcttcacgctttctcaacttctatttttttttttatcactaaaccctctgtttaacaagaagatataaagtgagttaaatgattaaaggagaaaagaagagggaaaaggtcgccggcaggttcgatcccctctactacaaaaaaactaacatttgcatactaaaaaaaactgatgtagtttaacagaaattataagtaacaagaaagacaacactctatatttgtgttaatatgaacaattctgcacaacagaaaaaaaaggcaaaattttaataattcagctacatgcaagaatggcatatggatgaaatatgagaaattatcatctcacatctttttttcctaaacaacttttacattgcatcctacattgctacacgtgacaaatattttaagtgacctcacctaggtagagaagaagtaaaagaagtaatatcaaaattttaaattgcagttccaatttcatttccattttataatattgtgaaaaattgtggacaaatgcagccgatgtggctacaattgcagctacaaacactctaaaaatcaatgttataactgaaattactgaaattatggttgcaactcgttttttaaaacctagggtaatagtgaaagagtgtaaaggggagtaaaagtaaacatggtgttaaattcttagggttcataaaacacaggtgcatggcactcatctatccaagagttaaaagaaaacatgtcaattagtttagtcaaaaaatttggccacctaatattatatatatgcgtgtgctataactacctactatttattatgatctatcatatcacttgtgtcatatatggtggattggttttaggccatgatgcgcagaccataaggaaaatccttttaaattagtttgttctatatttttatgagaaacattaattaacaatgtaaaaaaaaaaaaaaaacttcgtaccccattgcccagaggctcttcgctatgcgaaggtatgggggagggatgttgtacgcagccttacccttgcataagacgttgttttcggattcgaacccatgaccaacaagtcaccaagacacaactttaccgctgcaccagggctcgccctcattaattaacaatgtgaacaaggaaattttaatttatataggctctggctcaaacataaaaatatgtaaaagaataatacttactatcatttgtggaataaattgagggaagtcaaagctctttaagaggaattggcagatttgggtgatagaaaaaattacaagcacctgcaactcaaacaatgggagtgaagatttcaatggagtccggccattaagttggccaccccataagccatctgaaacaatattgggtggaacaacaatgcacacattataggttaaaaatttgattttatcaactgacaagaatagagtctcatttgcacttaaattcatatttgttaacaatgttaattttttatatatatgaaaataagggatttacaataactaatacacctttgtccaatcaactgagttagactcatttgaccataatgtgaagctactaaagagagaaatgagaataaaattcaataagagatagttataggaagatcgctcaatagctagttgtattggcatcataacttctgtcaccaacttttgcctttttgttaacatgttagagattgtgagcatatgcttcgatgttgcaatgcaatagaaaacataacaactaagttttatgttcgaccacgagggaataacagcattcaatcccataaataatcttttgaggttgtatagctattttctattttcaaccataacagtatatatttatccaagtacagacttttttctattttcaaccatatactattattagatatcttgtagttacaacctacagctaccttttaaaaaaaaattaaaatgttactactactgttttatgtcttaataaaaagaagagatatggaacgcctttttgcatgtataccaaaattaatcatcttgcatgaattctctgttgtgatttttttcatatttaaaaatattagaaaaaaggcgtttcatgactaaagtagaaatttaactatagatcatgatccatgacaaattaacaattggaaaactaactacttaagaatgaacaaatctcgtgtttagttactacacttagtatactatatttttatttttacctcaagaaaacttaaaataaaaaataactataacggtgtcataattttataaaaaggaatgcatattcctgtagtactgatctttttccccccaacataaccaattttttttacggtatataactttcccctttgcacagatgtcacaaatttctatattggattatatgtagtacaaaagataagaggtgtatggatttttatgattaatgaacttacgaaatagaaaagtacaatttgatgataactttgaatgaagaaaaaaggtaaagataagaagagaaaaacaaaattgccactacaatatttagatccgaactaaaaaaaattagaaataaagaaatcaaaatactacaagtaaatggataaccgcgtaataagtcttaatagatagtggaacataaccgcgtagacaagtttgtatttacatgctcagatgtggaccttaagcttcgcccaattaaacgaaaaatatgttacacgcaaatgttgcagccataaacactagagatatacacatacaaaaagctgaaactgacaggaactactttcaagaagacctgaatgaaactgaatctccatgaataagagaaggcagaaaaaatctgcttattgtattctcacactatttgcatcaggtatcttccatgcaaaagtagaaacaaatccatgtagcagcaaaatgttgtgtacaacaactcacgtgatcaacatatcttgcattaagtgatatccaattggatttctatggcatgccatgatgccaaaagatagctttttgcaaatcataatatgggcttcactaagtctatccacccaacatagtaaaacaagaacagaagctatgagacaacagagaactgcttctgttgtcttcgcatcataacagccaattgcagctcacctcgctggcataacttcactggatctttgaatatcgtgacccttgcaacattatttcccattatagcgacaaatgcaatgctaaaagattggcctctttcatttgcaaactgccactctctcgctgatatgttgaaccagtcttttcttggagatctggttgctttaacttctatgaattcttggctgttatcctccccaatgactaaatcatatggaagtccagtttcattatctttattaacccaccttactgcagtattgccaactttatcgacaaagtatttgcatgcaagaaattcacctaatctgccagtttcctttgcttgtgcagcatcaaatgtaccagtttgtaattgatctctcttgccaaaagctggtgaactgaaatgagcttcatccagagattcatccaaactaacaggatcagaatcagcatggatactaaaagcagtgggatcaaaatcatgacaagattgatcttcaaagttatcattttcatgcaacactagtgccactgaacttgctggtggatcttctttgaaggtccagtcaacagtaactgatccttgttcagcacaaactggtggagaaattatgcttgctgaattgtcatccttcttcatttcagaaaagctgctaatctgggaaggtttggtcttgaaaccattggcctgggcatacctgaaatctggtgcagttttccaaccagcaggtggccagttggggcatactccgggcttccttctaggaaagatctgttcatttgttgatgggacatgatctgaagggttcaacttatcagcctctacaattgatgacacggaagataatgtccaaacagattcttcatctggaagttttggtactttttggctattcaaaatgaaaaattctatttgctcctcagaggaaccagattctgtcatggttgttatcatatgaaggaaatttgccaagtgcaattcagaagtcccatttagtaacaaactagaaagctccataaacaaggaatgataatctgattctttaatggtgtacaaaatgtttccctgtaagaaacaacacacatacaaacacataatataaataaaggttcagaagaaaaacgttattgcaataactaaactgtaatgtgtttgtgcttcagatagacttatagagcaattgcttgatctgtgcaaataaatcatcaatgctctcaacgatattctaatggagcagtactgatatcctaaaaatctcttgaattgatgatgaattgagaatcaaggttgcatttagctcactaagattgtcaatgagatttttagatctaagaaaatgccagatgagtggaggaagaatactttggtcccaatttttaagaacaaatgagatatccagaagtgcgctaactacaaaggtataaaacttatgagtcacactatgaagctatgggaaaaggtgattgagcatagattaagagaagaaacaaggattgcagagaaccaatttcgttttatgccaagaaggtctacaacagaagccatttatttttaacagaagttgatgagaagtacaaaagtaaagaaagagacttacatatagttttcattgacttgagaaaagcttatgaccggataacaagagaaatgttatggaagactttggacaataaaagtgtgcacatggtttatatacagactacacaagacatactagtgcgagaactccaagtggtgaaactaaggacttcctattaggatagggttacatcaaggctcaactctaagtccttgtttaatctaatcttggacgttcttatcaaggacacacaaaagataattcctaattgcatgctttttgctgatttttttttttttttatcagcaaaaatagacaattatattaataaagtaccagcggtactatgagatacgtaaagagggaacagatttttggttcctatgtagacttaatgtagtcttgcaaggaaccaatttctggatacaactcgtacactaattctattatcaaactgtctttacaccctgaactatgttttaaagccaactgtgagaaccatgctttttgctgatgatagtcttgattgaagaatcaagggaagtagttaacagtgttagaaaagccacctaaattatggtcacctctagatagaggggtgtgctgaaagccccacataatgggtagctgtgggcaaaaggggacatgatgaagttccaaatcaactaaagatagtgtcgagataaactatataagtggggaacaattctcaccttacaagctgattttgtagggttgatttaggctcataactcactttctaacaaacggtaagcttgagctctggaggcagactttggaacacagaatttttgcttgagtaggagaaagacagagtatattcgttgcaatattaacaagagaccagaggattttggctccgaaacgaagttgggagatgtcatgccacaggtttctaattttaaatagagtatttggtatcaatcatacaagatgatagagaaattcaggaggatgttacacataggatacaagtgggatgacttaaatggagaaaatcatcgaggattattcatgatcacagagtacctactaaattcaaaggcatgttttatcgaacaactatacgtctagctatactatatggtagtgaatgttgggctttaaagggacaataggagacaacagtgggagtagcataaatgagaatattaagttgggtgtgtgatcatacaagaaaggatagaatgcatgatgactatatacaagaaaaatatggtgtaggacccaattaggaaaagatgacagaaaactggttatggtgatttaggcatatacaaagaaggccacaagaggaggtgcccgttagaagaatagattgcatggttgttagtctggtaaaaaggagtcgtgggagaccaaaaaggaggttggaggaaatcatcaaggggaatcttaggctaaacaatatttctaaaaccttggtttttaaccgtgtcgaatggcatcaagtgatccatgtagctgacctaacttagtaggataaagctttgttgttgttgaattgagaatcaaattgtgcacagtaagtgtcacacaaaaaaaatccaaaagaggatggaacttttcagattttgagtattaaagatgattaaaagtttgaggaaaatctgattcaagcttgtaattaaaatatctggtcaaggtgaaataaaaatggtctttcaaactaatagttgccagattcaatattctatattttaatccaagtgaacacttccataaggtttggttcagtttctatcaagaacatacatcaaataaaggatgcacagcttttagataaaaagtttatgaactccaacatacctgcaaaagacaactacattcgactcgtttttttgatacactgccacaggtctttataacattcctgtagaacagcttctcaacaacaatgacattcagatggttgaaaatatcaaaaccagactgcttgagtttatcatatttatcaatatgaaatttatgaatgtagcgctgggcatatggcagagtccagtttaccaatgactttttcaaactacaatcagcaagaccataatatattggttcccgagttaccacctgcacaaagtcataatgcattaatgtaaattcaaaattaaatgaatatcaggtttaaataaattttatctatattacagaagaaaactgaatattcttggaatttggcctaactcaacacaaaaaaactagcttgtaaggtgagggtttccccccgcttatatactttaatttggtcatattactagtcaatgtggcatctccaacaaatattatctttgagtccagggggataattttgaaatttattccatcagatgaaaataaaatctacctatatactcataataatctttttaacatcacccattgattggggaaactctgagggtaaaatgcagagtaatagtgggaaatagatggttgaagttgtgattaaaggcgttggagatcccgcatcgactagcgatatagccaaattagtgtgtgtataagttttttttggggggggggggacaatcatcaccttacaagtcggttttgtaaggttgagttaggcccataacccactttctaagaaaaggcatgtctctgtgtaacaaacaatgaagtgcaggcccaaatccccactgttttgtgcaccagtgtaaaacaataaaaaatacccttgcttctcaattgaaacccaatgttgtggcaatggagatggctaaagggtggtgatggttgggtcaactggaacaaacaaactagtaacaatctttagtttctcttctcatactaccctgtctctacccaccctccaagctgaataaagatagaacttaacaggatggacaatgatcagctggtaaaatggaaggactagaatcccaaaggacgaacaaaatttggcttactatcatagaattcggattggagaggtaaaagaagcccttaagaggatggataatggtaaagatgttagtccaaatgatttttctgttagtttggaagtgtgtaggagacgaaagtatcatttgactcacatagaattcggattggagaggtataagaagcccttaagaggacagataatggtaaagatgttagtccaaatgaaatgatttttctattaaagtttggaagtgtgtaggagaataaggtatcatatttgcctcactaggatgcttaatgacattttgagatctaagaaaatgtcgtaaatggaggacaaacacttattccttcctatctttaagaacaagagagattctgaattgtgtaaagtacattagtataaaacttatgagccacactatgaaagtaggggggaaaaggtgattgagcaaaaattaagagaaaatatgaggattggggaaaatcaatttggttttatgctagaaaggtttacaacaaaagtcatttatcttttatgggaaatgatgagcaaagagccttggagaaaacattattatatgatttcattgacttggagaaaacatatgatcaaataccaaaagtgttgtggaagacctgggaaaagaaagctatacacgcagcttatattcaaactatggttgtaattaaccgctgtatacacgcccaagccactccaagataattcccagtgttaaaggaaaaatgcaaatcatcatgcattcaagcacaaaaaaaatcacagaaaatttaggactgaaatagaaaatctggaactgggcatacatgtatatcagttatatgtattagtgtgaacaccataatttaagaagtgccaagactacaagaataatataacagagaaaaacgagtagcacaggagaaaaagtgatcatacctctgagatagctggaatacctaagtttttcatgaggatggaaattttttcttgccccatttccttatcatcctcaaccagttcaccgaaatagagaaagtcgaggttgtctgaatgtttaaattcctttttcaacttcttatcatcgcaccagcagacaagaccaaaggaaggatgcaacgaaacccacttatcttgcacagtgggaagcactggaaattccaattttgaaagacattctttgagatatgtgacatcctcaacactcagcaaaccagattttagtccatctgcccacttgaggaaaacttgcaaaatctggagaaagagcacagggtaagatttcaggtaaaagaaatcacttattatttatagctcagaacttactttatctgctgcttgtgaaggcaaagtaacagttgataactgcaacataatttgaatatagctgcatagaggaggtgcctcttgtacttgacattcatcaacaaagaaaccacgaagactagggtaaatattgcataatgacttgtttataggggaagaagatgagccacattgaggatggaactccttcattttctgaatagaaccagttgaatcatgccaatagacttcattgggagacacaaacgtcccacatgcagcatcatcatgatcatagacagatgagtatgggataaatataaaaggtccagacatcaaaccttccatagttttcttctttgaagatgccatttcattccaaatgaatgcatacaatttggtcatttgtgttatgctggtgaaatcaatacatattatttgtgagtaaacttgttaatttaaaaatgttaaaaagaaaacgaaagaagcactgatagtcaatgcataggcaggtactaatatctgtgtatttactatttagccactctcttttttccccttcctacctaccatctattggcagaaaaaactcctacaaaaataacaataaaatcatcacaagtccaaacatctattggcactgaacctgtcacatcctttcttttctcttgtatctaatcacattattaatataagtggatgccaagcaatacaagaaacttgagcgctcttccacttaagttttctctctcaagtagagaaaaaacgaaatcatgagttattgatgtaattgggaacatagtcctatattataatttctggccctcttacaatgtatgaagactagaaccccttcagagtttggattggattgatcaatgttaccaacaacagtaatttccaagctttattttaggtcacataatgaaacttcatccaactctttattagtcttcgtttgtataagactccaaggacaggctgaatgttacaagaacacaaaataaggaatgtaaggggtaataaaatggatgtgaaattgctattgtaatccagtttttgttattgaaaaagataataaagactcatctaatgtgattggtcatgaaacgaaggctaacaaaagttttgatgacaaaagctattcaaatcgaggatagtgtgatttaaaagaggtaagaaaaggtctttatctatattgggaaaaccctaaatcccacatcggctagagatagtgccaaaatatagtatataagtgggagcaaccctcaccaatgaactagcttttttggggttgagttaggccaaaatccacattctaagaatctaaataccataaagcataatgacattcatttatctgtgtagtcaaccaaataagattggttgtggttgtttatgctaatagcatttctgggtcaagtggcattaattcacactgtaaccaaataatagaaacattagagaatggcccatattttttaatacaaaaagtgaataaaaatgaattatttgggattatgttttatgaaacttaatatgcatcttgtgctagcacatctatctatgcattttctggtgttcagttatattttctttattttctgttcctgatctgcttttacagaccaaaaggctataggtgaggcattttgatggcactggttgtgatatccctgttttaggctatttaaatctgtacttcagaaaagtatgacaaattattcttttttcttcctctgtaattctctggtgcctgcaatgttaatcttataataattatatgtttgtaatgttaaatctggtggttgtgtccaattaatttaaaatttatctctcacctcacacgtatctgtcttccatgtcatatctacctgtgtttgtattgttaaacttataataattatatgtttgtaatgttaaatctggtggttgtgtccaattaatttaaaatttatctctcacctcacatgtatctgtcttccatgtcatatctacctatgtttgtaatgttaatcttataataattatatgtttgtaatgttaaatctggttctggtggttgtgtccaattaatttaaaatttatctctcacctcacatgtatctgtcttcgatgtcatatctacttgtgcttcctagatgaaaagtgtggcagttactaaaatcactgaagttaaactttggatgtaaaagctgaaaagggacatgcatacctcgccttgaatggagtctttgatgattttctccaggctttaagaacatcaaaaatgtcatcgagagtaactctagtcttaaacccaaaatcttttaccaatctttcacttttcacctgattgaacacaaaacataattagtatcaggttccacaatcacttttgtttttccagccaataatgtcacattattcaaaatccaaatacacactgatgtcacacaggtaccagtagcacaggtaccagaaccacatggaaacatcaataaacgctaaaacttctttcaaatattcaaattttgaaatttaataaatcgaacattaagaagatacacaaatgatatgcctcatatacaatcctaactctagcagggcaagcaatccaaccatgaaacacaaccaaaataaaaactaggaaataaaattctaatacaacataaatataacataacaaaagaccccggtaaataaaccatgctgataattaatctataattccccaattacaaaccctatttcccaacttacaattacttaataaacttaaaaacaatcactaacatcacccactcatgctgaatatagagaaagtacatgagagaaaacaaagttttattaatactgaatacacttggttatgatctgttacaatagaatatgtatacacaagctgaatcaaataaatgtaacagccagcctaaaacctaacagaaataacagactgacagctgttacacactaacacagaccaactgaagaaagatgcatgctaggtgaattggaacagaaaaattctacaatctctcactgaaacaaatgtaccaaaaaactaacctttggaacagcatatggtgcaaaatctccaaggagcatccggactgtttcacaatcataaaacaaatctttaggatagtgtagctcatcatccatggttgaaaccacccactggatatcacacaggctgcatataaaagtagacttaaagggatggccatctccaacagatttaagatagaaataacccgtagttttattactataacaaacatcccataatgtatcaagaacctccaagagatatttacaattttctagattgccacttttagacaataaggatactaattgcacaatttcagaggattcccaatctttgactattgactcagcagatattagacccctatcccacatcatctgcttaaatgtgacatcacatatatcgacaacactcttatccacctgaactacttgagcaaaatctgtgatgccaaatttctcaaaaaaatccctccacttaatcagtgcagatgaaactgattcatttactgggtggcttaaatagcttatgtcaacctcatgccacctcatactcacactatcagccaacatttttggagtgacaggattcccaaatccagtacagaaatgaattggtatctcagcaggacacttgaaaccataatttgtcaataacaaagatttacatctaaactcggatattatatgctccctttcaataaaacaatcagaacagctcgagttcaggtgtagcattacaaaacatacatattcaatcatcagcactctgtttttgtttgccattgtttcatcagacaatgcaggtaaaatatgcagcttcacaacatcatgtacagacaactgttgaacaccaatactctgaagtaaccgggtaacattgtccaaaaatgtcacattcaagctcggagtaccagaagatgcagaaaaaaggaaaggacttacagtccttagtttagcacatatattagggaaagcttcaattttatgctcaccatcaaatcctgtgtttaaatgattgaaatgcaaccatatagtgccttcatccactgagctgtatgtaccatctgaaagtggaataaatggcattttttgaagatttttctgaacatctttcatttcaaaattgattggcacagagccagacgaattgaacattgttacagaaagaatatttagacaagaagctaaccaactcatatccatcgatatcagaccactcttcgtatggcataaagatgacagtactcgaacaagaatgttaggcccaaactcctcaatgcctagtgcccttgctagttcatcagacaatactatatttctatccaggtatataagcccaaggtgttcaagaagcatgttgtcaggaataagattacgcacctgctctgtccaacctctcaataccttgcatggtggggcccattcattattgtcaccgtccacaagtaagcaattcatcatacgtaatttagaaataatcaagcgaggaagactggagaaaaaaccatgcacttccccaactaaaggaacaaaactcatgaaagcagacagtccctttccaggctcactcctaaaacagggaagttcacaaaactctctctgtgctctgacaaacaaattaggatactctgacaataaccactggttccatggactatctccatcaacttcctctctagatgaaggaagaacaaaatcaccttgaagaataaacttcaggccatatgttcttaaaggaagaaatgcaaaaactggctgctgatctgaacatggaatgtaaccattatctgattcctgcagagtaaacgccatagaaatttcagttgtctgcacatcaaagcgaatggaatttgtttgcaacttctgagatactacaaaccacactattttctctttcccatgagaaaccttaatgataccatctcctgaaatttcttttttcataacagtaagtgtatcattaagcaagtttcttaacttgatacacttgaggcggtgaagaaatagtaacagtgaaggatgaagatctgaaaacatagacaaaacactattcatggccattccttctgatagatgagatctgaatggaagcagaatgcatgtgttccagggattatcgtcacacaattcagtatcagtagatgccatcctcctgagcaccccaatgtcacaaggaggtactactgtgggcaaaacaaaaccaatctggccttcactaatgtcaaatttaacatgaaaaccattggaatgaatttctggagcatctgtgacctgcagtgggaacaagcaaggttagtgaaactcattagaaaaaaatggagaaaaatgtttgtagtgataattccatatagacactatgtgtaatcacaaaagtgcaacaaatagataaatttatattattttgtctattttaagtaatgtagaaaataaaattataaatgcatatcataattctaacttgtcctaactgaatcaaatggcattgtgtgatccatctagctgacttcacctagtaggaaaaaggattttgttgctgtaacatgtttgttatcataattctaacttgcacaatatatataactatttaaaatttacctattatgaggaaatgctcaataagaaaacattaggaaaagtcagtttttaatttgatcatcaacagattaaaatttattcgcaagtatcattttgctataaatgcaacagcaacacctgtcttgttttggtgaacaggctgatgatatatgtattgtacatgtatgtttgcatgtgcatactaaatacttacataacttgacacattcaatagtaaactacaaaaaatggaaccttgattaaacagacagtcaaagcaagaaattattttcacattaagtgttataattagaaaaatatagtaacaaaagatggcaatatatcttattgcatttgtatatcaattttataatgcagtaaatcatatacccagtacacaatttctaaagtattgttcacatcatcttagcctgaatgaagtatgacgtttcttacacatgatttacattttagcaaacaatgcactgaaggaaaagcaatgaatcaagtacagcttgcaaaatccgacagagggacaaatacaaacaaaaccagagaaccatcagatactcagattaacagtagcaaaatacagcaaagaaaaagcatgaagatgacagaaaagcaaaaaacaaatgaaaaattacaaaaataaacgcagctaatctagaaccaataagatataactcaggaacagtattagatgtgataaactcagcattcaaatctggaaaaagctaattgtatttttattccctcaacaactttttatttgtttagtccctaattttttaattgttacaatcatgtccttcattcaatttacatttaaattaaaccctcaactcaatttttttactcaaaaaagtagaggtttaggatggatttgagataaaaaaaatgttttgaaaggtttagaaatagaaaatctgatcaaatttgaaaataaaaatggtgtgaggttaaggtttcaaagaacaaaatcttaagcagaagatggtttaaaatgatttaatggattcattcaaggaaaaatttagaacaacaataagaatttgagagtcttaggtagaggaaactgatggagggacttgattgcaactaaaagaattgaaggactacattgtaacaataaaaattcaggaaaaacaatattgggggaccaaaatcgaagttggacctttggataaactaatgatattttaaagagaacctaaagaaaaatgtttcttcaacatactcggaacacagacttgaaaccaatgcctttcttccctatgtatccagcagtagatcctttctttgttgaatttccaacatcacaaagtgctctcatattttgagctgagaaacctcgctcattattcaatacaacaataccagaatctcgaagaataaatgtaagagttggttccacattctctggataattattgtcatctgcattttgaacctgaatcaaaagaaaaaattatcaggcacatgctctcagagctaccaacagttttactaagtaccaacaggatagagaaattatccaatataagaatggatgttaaatgtaaatgatttattactatcatctgcacataaacagtgaaaaatgatactgaattcctctagaatgaacaatctatcaatggtgtggatatgatgttgtcaatactccaaaaactaaaattgaaacagatatgggaaaaattctcagcacattatcactgccttaaatctatattagatttatctcttctcgccaaaattcaacttcttagcaaatgttaaaagtgaaactcatatgtctatcaggtaataatgtttgaagtttaacattaccatagattttcagtacattttatttatgaacaataataaggaaaaggaatcacaagataaaatgtcaaaggattatcctcaccaattcaagaataaaatgagaatcttgagaatatagctcttgtgaaaggcaatgcagtgctctacctaaccgagcatgttgcttcttcaacatgcaactatcaatatcagaaagacttgaatctaggccaaattcatctcgcctaatagattcaataagccgagaagcatccatatcttcgacatgttgaaatgaatttcccagacagcaagtgttagattcatcattagatttttctggatcaactgtttcaatgatttctgtacacccttcaataagtcgatggggtacaagagatgtaaccatatttgcttcaggtataggagacttatccaaggtaacttggtcaagcttcagacttgtgtttatatcagttgtggcatcttttaagcatgaaacacgagcacaatgaatgtcagaagagttgtttgaaataagtgcatggtaatcattaatccactcagaaatacccagagataaccctatttcatgaagcatgagacgttgctccatattgctgcattcacataaaatagttgaagcggcatccttgaaaacagattgcatcccagaaagcaacacatcagaagcaaaactgtgaaattcagccggtaagttaccaagacaatcaaggacaaaccttgacagaatggatgctaccttactcactttatgcatgtgtttgctaaacacacttctcattttagcagttgaaatttcagttaaaaattttgttttacttaatgcttccacagactggtggagagcattcccatcattactaacttcaacatcttctacagagtttctgaacataacttcaaatgcatggcaggaatggcattttagaagtgacaatggaacatatttttctcccccaacaagtgagatcagagacagcaaatgcactgcagtttggaaagaggatccttgaactgcagcctccaggaaagagtccaaggtagcagaatgatctatccgtatcacctttccatctctggtaactaagcaaaacagttccttggtatttacatcattcaacagccacgatataaatggacctaggaagggtgcaaacctaagatcccaatgagaccacttgctcaagtcagacaacattggcgccttcagcaagacttcaattgcattttttgctataacagtttcagtgctttttttatggctcgtttcagacctatcagtgggaatttctgaccaattgttatctctatcacttgatgagtctccattatagttcttttctataatagtagcagaaaatacaacacattttgaagtcacgctagatgtatgccccttaacagtatccagcagatccacaagagagccattttccacaagttcaaaattaattgaagggaactgcctcataagcagcatggatatcatttgcttggttattgtttcattctcccacaaaccacttagagcctgagatactagagcaatcaattgatttgaggacatacaggccctgaaagaggaattttcgcacgtgtcaccaaccaacaacttcagtagttcatgaggtaacaggttagggtgcttctcaaggaatgataagaaatctccataaccaagagaatcgaattttttcataccaaactgctcagccacccaattttcacagctgcaaaacttcctccacaacataattctatattgcactagtgagtcgttactatttctatttatatcattgccatggtcaaaataagttccaatttttctgatgacatcatcagaagaaatacctgtgacgttcaaaaacaaagtttgcaatgtcagcaacaatataaaagagaacatatataatgaggaaaactaagaaaaaaaaataacacaataatgctcaaatccttggaatttaaaagagaagaaaagaaatttcttaagtgctcatcaaatagattctaaatctggaagcacagaaataatatagtggcggttagcattgacatggactatttggaagcacagaaataatatagttttctccaataacactttcaacgcaaataaaatgatggatgaggcaagtgtttttgctatggacttggctgaaatatttagagaaggatttcaccactcattataatcagtggtcttcaaatctaagatatggattttgccgtagttgacgataggaatgtaggtcaaatatttgtactagtctctttatgcggtttacattctggtttggatcaaccaattggctgatttgaactacagcagaattgtaatctgaaacttgtacctattagtacctctggtactcatttaattcatacatattattttggatgataaaaaaaatagattctaaatcatcaacatataactcttaacattaaaactactcagcagattaagctgtattaagttccaattgcaatatttgtgaaacagattgactagttaaaattctttacaatcgaaactgaagtataaaagaaaagattgtaaatattagaagataactacacaataagtcagccaaagcttgatttaaaggcaaatagactcacactttgtattctctgtgttatccttagttatgaccggtacattttcctggcctggtccaacgtctatagtatcgtattcagaacccttggtcggtgagttgcccaatccattatcgatgatagcttggaaggtatcatagatgttgttcctcattccagatttgatagatgaaacctaaagcattgaagagtgagaaatttcaaaagatgatgatatatctttaacaaaaagcctataagtaaaatacatctgttctataaggatatcacataatcaagcagaaaagatcatatagatcaacaagataataattgaactatttatacataatataactattagcatgtaaaaaatggaatgtgttatgaataataagtcctagctaaccatgaaaaaaaaatcaacatgaaagatcttttcaatcatcaattgcaactagctgtgaaatcctaaaatcatcaaatacttacaaccaagaacacaacaacaagcactcaatgtgttagatattactcacaaaacctctttctccttccagattttcatatctgtggtccaagctcaatgtggctgtggttgacatttccttcaattctcacccaccttgagcttgttgggggtgtgagaatataccttttctctttgtaatatagtattctgtccgtaagtttatataacagccgtcttttaacagctgttagttactgatagttacaacttacaactgtcaaatcattatgattcagcacatgtagctatattatatattctgtaaactggactgaactatgtgtgttttcatttttcacaaatcaataatatcagattcacattgacaaacagttttctctctaatagggtgtcaaacatgttaatattagctcactaagatggggatatatagatgaagctgaagcaacaaaccaaaactagtcatcttttagcactgtcaacttagtatatgtgaaaaggagattagagctaaattcaaaatgttaattaaactataaaattaactaatttgccataaagtaagtaaattaaattacatatgcagagataatatgatgaaatggataaaaagaagcttacagcagcattcagtaacccaatgaaaggatatgatgagaacaaatttttgattttcctcttctggaaacggtttactttagagaattgaagcatcatctccaaaacctacatttgtgcgttaggaacagagttacacatatctaaaacaagtactcaaaaagagcttcaaaattgttcctaactgaatatgtacatgaatgaaaattcatagaagagtatttgtttaagctaaaagaaattcattaaacgagaaaaaaaatacacaaatacaacatacaaggataagccatcataaaggggagaagggggataaaagagacggaaaaaacgagaaaagcacattgaactctcagaatagaaaataaaaaaactcctaaaatatgaatgaataacctgggcacataaaaaaagattcaataaagcctaaccaatggttatattttgtaaatttcaatattgctagtggctattgatattcaatacaagagagaataataattcacaaaaatgaaaaagaagagagacgttcaaatcaatggagcaccatgtaaaataaaaccctccaaatatattttttaataattagagggcaatttaagaccacaaagacaaaataaacctatctccagggagaggttggggagaagtattgctataataagtacattgctatcatctcatttaagtgatcttaaacacctacctcggcaaccttgtgctccgaacatgccatcttccaggttgtgacaaacatctgcaaagaatcattagaaattgaaagatcttcatcaatattggttgataccttggttttgttaccagtattgattggggttacaactccaagtttgtttctcttacgcaacttataaggagcagatcttgtagaagttgcattttcaaattttcttttttttctaggttgctcactaaatccttttttaaggttgctattaacaagggagtgccccgccatatcactcctcaccccaagtcgagccttctcttcagttgcagatgggtaagggcaactactcactcgttctgaacttctagtgaattgtgatgatgggtttgactggctacccttaatgatgttattactttgttcatctgtagaagaatcactatcttcatcttctgaggctgatgacataaatcttttatgctttccacaaaaagacttttttacaggagaaaaagactcaacacgctgagtaatggcattaaaacgttcatctaactgttttttctgagaggaaggaatagtacggtaccggaacttcccatttttcaaaaatgactccaagcatttctcgtatgctgattgctctgaattgctagcttcctgtacagcagattgctctgaatttctagcttcctgtatggcagattgctctgaatttctagcttcccgtcgagcagattgccctaactttctagcttcccgtcgagcagattgccctaactttctagcttcccgtcgagcagattgccctaactttctaacttcccgcatggcagattgctctgaatttctagcttcccgtatggcatatatatgcattctgcgaatataaaatcagtaatttggataataaagcctatctaaatccaaacagataacaaagaacaaacaccctgacaagataaaagcaattatttctatcctctatgagtgttttaaggtgtgggaggtggatgttgtgacctaatattaatatacattgccatagtgaactgtccatgcacatcttttgtcttcacaaacaaaatttacatgtgaaaattgcactcaaatatcaatatggaacattggaacaactatatttatcaagcaaataaatccagcaacaacaggttccaacactgatactacatatattaagtttttatccaccacataaaatatcatctaatatataatccattgagaaattttactggcttactaactgctctcgtatatttagcaataaggcaaatctcttgtgtcatcaatttctgtgaagagagttaatcaaatcattatcacataaaaatcttcaatctattacattcacttcctctttctaataccacttataaacacgcccttcaccaaaaatataagagaaacaagaaataacataccccaagttctgaatccgaatcccaagccattccttgcattcaaccaatcgcttgttggcaataaaatccaaaaactgttcaaccttgatgaattcattacttctagaagcatccaaaaactcaattagcaactgaattatttcctcagtggtaatcttatacacctgggtaacatcagagcgaagcgagaaataatgaataaccaaggggtgccgcaagaaaggtcccaaccctagctcttcaaagtcatcgacaccctcattcttgcatattgccacttccaaatcatacaatgaagtgatcctctggaccccgacaaagcaatggacaaaagcattcacctgcacgtcaaccaaaacacaataaccccctttcttatgtaaaactaaacccaccaatatcatccttcaagtattattctctctcaacttaaatagtcctagaagtattggaaatcatgttcctgtttggatataagccacaagtgctgcttttgagagcctttctactggaaatatagagctttttccagtagagaagctctcaaaagcacttctagccttgtattcaaacaggctctacagtctcccagatattaaaagaacccttcaaattggttcttaaagtttacttaaatacatcaacttaggacgaaagtgatggatattcaatatttgatggtttattcattcattattcaattcaatcactaacataattaaatattgaataaccatcactttagtcctaaatgagtgatatgatatgaagatatataccttgccttcggtcatcataagccgatgaagtgagggaacttgctgcattttgatgcccaacgtgttccatgaatccacctggagcgtgaggagagcgttctgggaaaccgtccacgccgagacggagtcgccggcggcgagaagagcgcggcaggcgttggcgatggcgcggtcggcgtgttcgattgcgagattagggtttggaggcggaggcggaggaggggatgggttctgaggagggaaagggcaagaggtgtttgggaatgagaaagacggcggcagcggtggttggaagaagacgctgttggggttcgggacatttgggagcgccggttgttggaagaagttgttgttagggtttgcagactgctgcggcggcggcgggtgtcgatagccgccgcggaactggaaagggtggccgtacattcgcgggaaaaataagaagcgaaggcggcacaagcagaccacgctaactacactactagtagcagtgaaggagaaacatcagcatcattacggggttttgtttagtactaatgtaattgtaaattttgtcatggcgcggttcggcttttcataaataaataaaaataaagtcctcttgaaacacaactaaaaacacatggagatttttcttcatgcacccaccctttttctcgtacatccaacaaatttaagaattttttaaaattatccctgataataaacaaatttgtaatccaaaagaaatttatgaatttatgatatataacaacattaattattttatagcataatttaaaattaatggtccatgtaaaacttgaacctatgatttttgtattattaactcgataccctaatcaattgaactagtaagtcaattatcataatttggattcacaatccattcgagccttatggaagggtgtttttggaattcccctctcacagctgattgtacaagaaaaacgttggatgcacaaaacaattctcaaacatgtgtttcaacttgggtcgattttttcaataaaaaaaagtacttgaacccaactaaaaaaaagcatatattatttgattttgatcgattttcatttaaaataaaatatgaatcaaaccaaattaatgtttcatgatttgatttagtttgattttttcaattttactaaaatgttatttcattaaaaaattgtactttttaaattacattaaaaaattgttaataacaatttatgaaacttattaatatgttaaatcttctataataaaaatttgttaaattttttatcaattttaaaccaaacatattttaaagaagtcatctgaaaaaaaatattatatatatatatatatataacactacgaattactgtgaaactcaaattatatacacttaaaaacacaacattaaaataatatgtgttgtgattttttttttttgtttcaaaaacacaaaccacaaattgagttaatttatttgagaaaaaatcattcaaacaaattaaaaagaatcgatttggattgatttttagtttttattaatatttttttattttagatcaattgaaaatttgaatacctttaacattgaggtgaggtgagatttggatagtttaactttgacttatttactcatccaggtggagtgattcagaaaattttattttgtaaaagtaattagattaaattaagttagatcagattaaattttttccgtaaaaattttattcttgtgtagcatacctattttaatttaagtataatcaagccatgctaaatcattttttctttttaattaattcagcaatgcagatatttgaaggcaagagttttttctttttgctttgactcagacttatttactcgtctgccaagcggtgtaatttggggaaagtttactttttaaaaataattaactaataattaggtgttttttaatataatagtttataaatattaaagtatataataaactatatcaatatatacctataatgttttttttttcaaaactaggtccatcttaataggttaaacaagataggtaagttattataaatccaatccattcattgtttttcgattctcacaaataaaacaaaaataggaaacattttttggagttatatataggcaacattgaatttagaaaaataaaaataactaatgagatgattcaatgagtttaatttctatgtaatcatatgtaaaaataaaaataaaaaacacaatcaactatcaactatactatataaaacatagttaacttgatttttagcaaatttattatatattatgataattaccttctcaatgcatattgttacaccccttgagtaaaacatacacattgttacaccgcgcgagtaagacattactcgtcttaatttgattagtttaatcaaatttaatgtatcatacaaacatttcaaatactaatatatattattacaatcattttaatttaaataaatctaattattatactaaaacttataacaacataatctttttaatataacaatatcatatgccataaatttattaacttttaaaataattatattaaaataatttatacaataatttatgattaaataactgttttacatcatgattgtataaacattacactctaacaataattttattaaaaaattagattgttccacatatacatatactagttactctagttcataattaagcttatgtgaaatttccacatttttgcattctctcaacacatttcgcattcactattgcactgtaaaaatatgaaagctattaagctagtctcccttggcaaatgaccattcacatggattgagaggaagagaggaggtctcacaaaacccatttaaatggttttgaattccaagacccagaaaactcggttaggtaactttccttttattcttctcatttcaccaacagacttcccttctttcctcttggagccattataaaaattcaaatttcaaatatcttagatattgtttagatttaaatatattatccaatatttaagatgtttagatttaaatattatttagtcttcaagatgtttaaatttaaagatattgtcaaatttgatacaggtggaatctttcagatgtgaaaacgatatataaattttatatcggaaaaagaaaaattaatgactcggtttattttgacaagtttttactaaaccgaaaaaccgtgggacatgggaaaggaaatgtgctaactgctaacttctgtagcttcatcttctccgcgtgacatacaggtttgtcatttttctttatatactgtactaaactctacaaaatttattctgcacttctttaaatataattaaaacacaaaccattggctcaaaggaccaagcacttcataagtgaaactagacctgcaatagtagaatttacacggatttggcagttctaactattctaaaccatcagataaactgcttcagaaactctgtagctacaagcctcccccttgtgttcaccgacattttgagctcgcttatctctttatcaatgtcctgtaatttgacggccattattatcagcaaatcttttaagtcgattacactaaatatcaaccacaagtacaagcaattggcaggaaaaatctgtaagcaaaaccattacaaaccttaccccatttgaaagttgtcgtataaggtctagtacctaacatctaaaataaagaatatcaaaatgtggtttgattttttatattttatttataccatgggagaatcatgttccataggaccttatctgatgctttccatagtcactccatagatacagtatctctaatttagataattactacaagccacaaaataaaatgcaaatccaagttatagggtcaacaaaattcttgcctccataaattgcacaataaagtcaatgagtttgtgcttctgcatctcctcacagtggtaatttgttataaggaagctaatgtcatatccctgccaacagaagcaacaggatgacaccaatgatcactaacacgttaccaaaaaaaatggaagtatataaatcaatgctaaacctgaacaggctttctcctcagtacttggaaagcctcggctctcattgagagaaatcttagaaattttttggtcaatatgttttcaagttcatcagcctgcttcacctgcacaggatgaaacagaataaaattaaaacaatgaattaggcacaaattataatgaatattggtatatttcatatgtgaatttaatgcttgaaaacaaactctcattcaaagattagtttgataaattgctgataaaattaaattgtaaggtgatataaagaagtctacctttataatagaatatagtcaacttgttctgacaaaatcctataacactcgttagcaactttgcattagtcatcatatatggacctcaaattgaaatttctaagattatcagtcctgaccctgacactaaaggtattaaattgaaatttaatattttttggacaggtaccagttgcacaaagtttaaatgctcctagtgcctgagtatcaattccagccatcccagctgaatttagttttaacttcagattcagccaccttattggtggtccatccaagcacagtgaaactattttttctcttattattgtcaaattctactcaccttctctacctacctattctctatttggtaattccaaatttccaacacactaagtagaacatgtttcaatattcaagagaggtacagactggacagcacatcattctgaagctctatacattgttgagatgtacattaacagcagcgaactataaaaaaggaaacttttaaaagaggaagaagcataaagaaaaatcattaagttaatagccttccagttaggggaacaaattgttacaccattgtggacagagactcgattttagatcattttaacaaaacattagtctcacaaaaaagaaaaagatttaccttgagacttatccgcaatgaattgatagatgtttctattaagcatttttcagcctcatttcggcatatcaaaacctgtaacaacaattgcacacatttttccataaagcatggatgcaaaaggcacttaggaaggaagagtaaaagaagaaattattaagacacaactaccacctacaagagtctgcttgatcctaatgaagtatacatcatttagaaaggtaaactaaaagaagacattaatgcataacaacacttgaaatgtttgagtatgaaaatatgcacacaaaaaggatcctcagccttagtttgctgagagatgtttgtgtgtgtatattatatatatatatatatatatatatatatatgagaattgacagatagtacaaaaaatagttcatgatgaaggctacagcctagcctatggtgacagattacaggacagcttctacaacaagctagaaatataaaacattatcaaacaactttaacactccccctcaaactggagcatataaattgtgtgctccaagcttggaacatataaagtggatccgaggacctctcaaggacttcatcaggatatctgcaagctggttgttggagttaataaattcaatactgatttctttggactgcagtttttcccaaacaaaatggcaatcaatctctatatgtttagttctctcatgaaatacaggattagaagcgatgtgaagagctgtctgattatcacaatacaacttcatctactgaacatcacaaaattttaattttttaagaagttgtttaaccacaccaattcacaagtaacaagagtcatagctctatattctgcttctgcacatgatcgggcaacaacactctgctttgcttgcaggagactaagaagagtgacattgataggggtttatgccaagcattatggggtgacagcaatgtaaggtgggtagaatgcccagctgttaatgcctcaggggggggtgttgtgtatttggagtgatcagttctttgagctacagtgtggtgggaaatggattcaatctggtgcaggggcagaggaaggctggcggaataaaagtatcagttctgaatatatactcgccttgtgatttgggtatgaagaggaggcagtgggcaaacatcagatagctataggagacccttgattcagccttttggattttcattggtgacttttactgtctatgcagaccgtcggagaggaggggttttagtcagagggagtgtggtggaggggtgatgcggaaatttaataagtggattgaagctttagaagtggaagatatcccttgtgtgcgaaggcaatttacgtggtacaggccaaattttgaagcaaaaagcaagctgggcagggtgtttgtctcagattggaaggtgtttaccaaaatcccaaggaggcttgggagttagggatttggaattgtttaatatggcactgccagggaagtggagatggaacatgcttcaggaggatgattctcttaggaatggaattctggtttaaaattggatgtgggagtagggtgaatttctggactgatgaatgggtggggggctggagccgctagcagaaaatttattgcgcctttttgtcttgtctgaacaacaaaactgcaaagtagcgcagatgggctttatggggggatcttcttgggaatgggcttttgtttggagaagaaatttcttcaggttgaactgaataattatagtattcggccaagtgaacaggataggcggatgtgggtggctgtgagtgaaaatctatacactgttagcagggcttatgcatggctgtatgaggcggtagttggatcttctgaagaggagatgctcaaaagggtgtggaaagttaaattcccaaataaggtaggtcatttcatatggaggctggtgagggataggctgccaaccggaagaaatctatgtctgagacaaatacctgtgggggatctaaactataaatgaccgctatgtttgagggttgaggaatcagcagggcatctattttttagctgtgaaaaggtaagagatatatggctggagtgttactcatggattggggttgcctcagtggttcaggtggtgccaagggaacattttctgcaacattggtactgtgaatgcggcagaattgatgggcagagatggatggtgttgtgggcttctgtaacatggtgtatttggcgtcataggaacaattacatctttaacaacaaggaattttgaggggaaacaattcttgatgatgcaattttcttcatttggtcatggctgaagacactggaaaggggttttaatgtcctgttcaaaggatggagtagtaatgcgaggatgaattttgtaaggggaggagtggggtagaaaagcactagggggattttctgttgtgggaaatttttttgaggtgggggctatcactcagggataaatccacagaatctttctactatacatatcaaatgtatttgttaagattctctggattttgtgaggggggatgcctatgggctgtgtataccagcaccactggtgctaaattgttgtatctacagtatatataatatataattcatattttcgctgataaaaaatatctactattatccaaaaaaacaacaattgcatccggtcattctaatgatatattatttcatcccacatcctccccactaaacaaccttctatgttgatctctctctctctgtctggcctcttgagtgtgagaattcatttatgttgcagttattttttctcctttgcatttcatgttattttccccctttcagatgaaaattgctttggaaaccaattataatatctccataagctagcattataaattgcataaagcctccatcacaaggaaaatggtggaataagatatgtcttgaagtccagcactccactcaatccagaaatgctggactttatagaatatatagcacagtgcctacaagctccagctttccttctaattggaatctgtgaaacagctcatcacaacaccatcaactaaactgctgaagcacaaatccattccttccaactaaaagcaagctatctgcaccaaatttcccaagctattacctctgcagaaacagacggttaagcctctcccacttattggtgcatgtgaaaacatataaagaaagggcatttacaagatcttctaatttgtcaaactctattggcaacaagtaacaacttgattgtgtagcacttcgcaaaagctttgagccatggccctaacaaggaccttataattccaagaaaaacatctgaagaaatgaacaaagtcaataaacaatatgagtgcaaacaaggctatcaagcagaagcttggtagtgaagtatcccaaatttcgaaaaagctagaccccacaatcctaaatactggtcagttagaacactgaagaaggaaggggtttgaagaaacagaaatagaacaccaatctcattcttaacataaaacacccaacaataaatcatcatttgccttatctactttctttggcctaaggacaaatctgctatcaactagttgcgacacagaatacttgaaccctaatttctcttttcatcaggcttaataactatcaaggaaaaagaaaagcaaagatcatcttaaatcacacaccaattagcactagtaaagcaagtaggaaagaaaaaaaaattccaagcagaaatcactacatagtagtatgaaacgagatggatcttacgggattgagcaggagttcggggctggtcctgcacataaaccaacaaaattcacaaactcgatcacttcgattttttaataagaatcgtcgtattaaaaatggaaaatgtggaagtgaaatgggtaatttattttaaatggttttccattatcaattagatttagataaaaatataaaaaggaaacaataaaatggagcaaatgtgcaatgaagcagagagagacagcatacttgagttcaacctcgggcttgttatgcctttcgacttcttgacacggaaagttctggaaccatagcgaagaagaacaacacaacacgtgattatttatcgatgcgaaaataaacaaatattgagagtggcgttaacgaagaagtgatacctggaggcacattgcggcctcgagcgtgttccgaatgcaggtcaagtataaccgcaacgtatttgcctgaaacgcaaaaacggtgtgtttatataattgtacaaacagagtttagtgtaaagaagatacgatgattgaggggattgataagagcgtagcgtaccatgagtttgggtctgaatctgaagaaacgctgcgtttcgtttcgtttgggaatgagtgacgatagaatggaagagtagtcgtagagtgtaagagaggattaaggaaatgaatgagagaaaaaagcaacaaaaactccgtccagtggggatcaggaatttcaccaactacgctagattcgcttcggtgcggtgtgcctttgacggattatgactgaccccaacacaaaaaacaacaatacacctacttccatagccttttctattttcatctttgatctttctctttagttttttttttttattcttataagcttactctttttaaatttaataaaaaaaatcatttgttataaaaaaagtgttgaattacaattaaaatgaattaatttttaaataaatatttttattacttgatgtcaatcattgaattatttacttgttttcaaataactcttataaggtaaagattatctctacttatatattatttttttattatattactagtcgatgtaaaatcttaatacacaactttatattatgattaaacatctcgtgcctaaatagaattaaacaaggtggtcttataatgattttgcaagtggctcaatgataattatttatatattttattttgatcgcattattatacgactaaatatatttgaacggctagcttcaataatggtccgataacaagtgatttgataagtttaacaacaattactaatataggttttgatgtcattttagaatttgaatttgagacatttgtcaacctttcaaaattgatttttaaaataaaaattatctcacatatatgctttattttgactatatcattagttaacgtgggatttttgacatattttaaaaaaaaattccttaagatagaaaaataaataattattcatttaaaataaaatacatcgaacacaaattaaaaaatacatattagatagaacatttattaattaaaatgtagaaccattttacagcattatcctttcccaattaaataccttcacatttttaagttcatagattaatttcaaaataaaaccttgttttaatttttaaaatcaagggaatctaatacaattaattgaacaaaatatgtgagtattataaatattctagtattatgtttaagaaaaaaaccataaacactaatcactttaatcattaacttccagaaaaaattattcatttaattttttattttaaaaaattatttcttaaatttgatttcagtttgcttaatttaaactttaaatattgatacattccaaagtatatccttcctttctaaataaaattataaattatttctataattttctcctcaattttaaaaatttaaatatcttattgatgtgttaagattttgataacttatttctatagttttctcctcaatttaaaaagtcttatcacttcaatttattttatgtataaattacattttgtttaaatttaaaaatatctgtataatacatggataacttgccttacctaatgtcctagcaattaattgttcatttaagagtggacagtatgcgcatttcaccaagctcacgaagtgaaaaagttaaaataacctagagtaaaaattaaaaaaattaaaataagttcctgctattacaagcgtatttcaccaaggcccaaactcacattgaccccaccacccaagaaaaaatacgtacaaattataagtaaaaacaaataaataaaccggcattgctgtgagtctcacacttaaaagtcatttacaggcattgaatttgaaagagaaactagagatagaagagcaaaatgcaacattagactgactgtacacgaaacttgttggcaacatagagcaaatgactaatgtttgtggtgggataattttgcagcaacttgagattagaagtgaaatcacccgcaaggaggcgcttacgaacgagaaccagcattgcacagcatacccgaagaagagtctcctgcagagtggatcaccattatgaaaaaaacaacttgtaaaagcagtctaatagcaaaatatacagttgataaaaacttaaatttgtcttcatcttctagttaatggtttgctcccttgaactactcatgtaaagccaaattttctcctctttcttttgtcaagtaaaagtatcaagtagctatatagttttttatacaagaggcagtgggccataagtttaaatgcctgtcgattatagtacaaggttaaatatgaattgtacctgaggaccatctggatcgcttaaaagagtgtcccaaatgtgaaggctgtcagcaaaattgaattcctgagtcagcaggagagtaatccacctaaatgcatagaattgaggattgacctgacattcagaaccagaaaacatgacccatctgataaactgttcaataaccaaaagcaaaaatacattggttgaatcatccagcaggtgtgcacgcaaaaaagtattatgatgattagtcaaaagacggtcacttaactagttgacaaacataaaacagtactgacagacagaaaaaaagtggccaaaataacaattctaacatagagaaggtcataatgaagcaggaaggagccacactctcttgtttatttattatttagcttattaaacaaatttataacagagcagcacacaatgttagcataacagtagatattgcaatcatgcaatgtacaaataaataactaataactataatatcaagaattaaaatacttaaacagaaatgcctatcctctcgtaatatttccaaatttaaactgaaagggaactgtgagaagatagaataatatcaagaatatatactagaaactgtcttgccttagaagtgacctcaagatgtcgccacagctcttcatcatgttctctcaaaagctgggacaatctcgtaatagttgcacggattcccacaacactattgtcgagttgctgaacaaagttatctcgaaacccactcaatagctcaacaaaacaaaagaatgcatctgcttcagcaaaggcctgcaaattataatagggaactgttgagcagagttaaccaataatacaatagaaatacaaaggaacatgacagtattatgaatctacattactccaccatattgccacctatgcaaattgtttacaacaaaatcaacattcccaaggtcatattaattatttcacatattttctattttatgtatacagggcaatgctgtattacatttggtaaaatttattgtcccaattcccctaagttagcaatgattactttttcacttgtcacacctgaattttttatttgtcttccctttccccattcttgcagaccattcttctattaaagcatacactggaaagtatcaggcaaatgaacgaggaaacatgaactttttagaatgtatgcatacagtgcatctgatcagaaaagaataagaggaaaaacactttttcaaatgaaatttgcaaaatcaaaaagaaaaaatgaaatttgaaccaattagtctttagaaaacacaaatacaattaaaatgaacatactatggcaagtagtgttaacagagaatgaattcaatcaaggacaataacagagaatcaggtgtttgataatgcaaacccttgatagatcataaaacaaaaacttaaaatagtttatcaaatactcactgcattttcctcatctgggtcatttttgaacacgtagaatagaggagccaatatctcattcattccttgcacatatcttacacccgggtttaactttgcaaaaataattaatatattcttcaaagcctcctgaaaatcccccccgaaaaatagtaataattaatcaagggttcactcaagaaaaagacttgaacttggagtttgtataaatttcaagacaaataaaggaaaaacctgattagattttgcaaattgggaatcaccagagaaaaagtgcatatcaggatgagtgcgctttacatctcggtcaatttgatctatgatctctgtatcctacaaaatgcaaagacggaaatttgcttcacaacagccattgcacagagtattatagtgcattagcatgagatttatataattgtgatacaataatggacacgagttccttaaagattaaaatattgacagcagcaagaccattaatggaatgtatgcaacattatcaaaatgcattggtaatattgtgctgtccattattatcaataaaagtcaataattgttgggactctttaccattgagttgtgactcttttctcattgtaaattcttgtagtttaagagttatctatttataaatatatgtgtatgtgctactgaaatgtgaaagagaattcagccccaaaaatattctccttgttttatttttctgcataattttacagtacctacagtacagtccaccatgttcaataattccttgagcgttttgagactttcacctacctctagattatagaataccaccaacagttttaagctggaaggtatctgatggttttccctttaaataataagtactagtgcactttgcattctacctggaagaactgattccatacgctggtcttccccagactcaaaggatgctccccatgagtgatttctgatctagagagcaacgccctcgcacagctggcatcatcagtatcacaatttgccgagttgtacatcttccttgtgatttctgactagctagccacagaaacattcagagagccaaatagataaagcaaagagaatagaacatgcattaacaatcaataattccgaaaaaattccacttggacacacatgcaccctatcattgtgacagaaagaacaaagtaaattacaattaaattcaaacaattaatgtgacaacagattccttagaattatctctcttctacaaaccatagtctgtcataagaatcaatgtgataatgtgcaaagaaatgttatctacagctttagttcaaccactggcagttttcagttatttatcatatgatcttatgccttcaatccccgccaccccccccccccccccccaaaaaaaaaagtcagtttaaagttcaacaaaaacaatgagatgataacactaaggcaccagacctcccaaagcaactaacttacaggattcatgaaaatctcctctttgaattgtttgtactgaaaccgcttctttgctaattcagctgaccaaagccctcgatctggtggaagatatccaagcaaaagctgcaagtatcaataagcataaattgcaacagcattccatgatttcacttccatctttccatcaataatggaaaacactcttgactaaccaatagcaaccaaaccatatccttacttagacttatgaacacatgaccagtttggttggattggaatgggaataagccactcgcatattcagttaaatgatttcaaacacacatcccttccatttttcctaaataaacctaattcacctaaaaatatcagaaattaattttctattccttttctttatttatttaaatatcaactcaagcgtcattacattcctatccacaccaaacaaccacttaagctggatttaacgatagtatctatttcatcacacacaaataaaagaagacattaaaaaaattaaatagaatgcactgacactgtaataactattaactaaaatacacagagtgtgaatctatgatccaatttcaaattgtcacaaatggtaagtttatagactttctattttaaaagtcttatttgaaatgatttttcatcggttgataatgtaaaaatctctacagtaatagtgcaaggaaattaaactctaaaaaaaaagactaaatgtagggaaaaaaacagaatgaaaaggaaacctaaccttccacacagtagaacgtatcccagcagcatcaggaataccttgacacgcgaggctccgcaactcgctcatatccaccaccttcttcgacaactgaaccaaaccaaaaaaccatcacaaaatcaacactcttactaaacgcactaatcaactaaactttcaatgtcgttttacaaaagcaagcgaaggcataaggaagtaacctcggccagcaattgcgcctggcgagacacatcgtgcgcggaacgaaagccgtcgccgtgatcttcccgcggcgaatcatcgattctctgcgtcggcggaggatcgtggacggagggaggcgacggaggacgcggaggcggtggttcaaagggggtcacgacggcgggagacggaggacgcggtggctgttcgaaggggctggcgacggcggaggagggaggggacgacggcgatgatgaggaccatatagagctgttgagccaatcggggaccttattcttcaccatgctggtcgggtgattagggttagggttagggtttgtcaatcgtgatgggagagatgaacagcgaagcacattgcattggtaacatcaacatggccgtgcgaggttgatcacatggatgaactagcaactctccaattattctcaccaatctactttgattcttaatttaatttctaaaaatttaactatatcatatgtcatgttagtacggaatttataaaatgagtaaatagtgcatgtaacatttagaatgaagaaaaaattagttgattatattatgagtgttgcataaaattaactaataaaataattgaaaagtataaaatcacataaaaataataaaaatataatttgttaaaaaaacagaaaaaaatattgagataaaagtaaaacaaaatataaaaaattaataactaaaaattaacattttaaaaaatattattttagacaacattaaaaattattaaaaaaataatttatccaataactaaataagttttccgttaataaagaaaaattaattaaaatatcttatccaagataatcttatttaatcataaatataaagtttgcttaaaattttaagatttaatagatgaggatgttccttatctaattaagttcttaaactaaaaaaaatgatttttttatcttttataatttgtaattgagttcttagagttaatgagattgctataaattgttgtttttgttgccattttcctaacttagaaactcaattacaaaaattttacaagactatagacccaataaaaatccaaatagttcaggaatcaaaataaaaattcctgaaaaaattcaggaaagaaatagtacgtggtattaagttgttttgaggattgatattagcaaaagcttagcataaacttatttagggtttcttgaaggctatgatggggatatgagttttaatgaacgttggattaattgagtgatgctttgtattacttcagtaaattatatatggtttagattcgttatctccttaaagaatattattcatgtattattataccagtgaaggatgaggtgactgtcatggactagaagtttgtaaaggtgttcctacaatatcacatgtttcactcgcaatgattgttttattttattttattaggctttgatattggaagtttgtatggatacgcccttagtatgcttcaaatgctaaaggttttaaggcaaattaaacattcaatttacaagtgaatttttcatacattacgcaatgtttttaaatttaaatggaatttaaaattaaatatatataagataaaagatcattattgttttttaagataaaatataattactataatataataatgacaccacgtatgtcaataaaaaaagtatgataaaggttattcaaactaaataaattaaatcaaacttataaaactgaaaaatatataaaaaaaataaattattcaaatcaaaatacattattttgtattttaatttcattacaatactacaatattcaagagtcaaactaggatgaattaactttaaataataatatttaaaagaaatatataatatatctttcaaatcatatcaaataaaaaaagtcagtaacaaattaaaaaaaccctaaaaaatattctccttaattagtcttcaattttgtttagtacatccattttttttagtgtttagtacattcattagttttttttttttatcagcagtacattcattagttactactactcaagtttaacatgtaagttccatttacaaacagttaaattgcgtattattttttttctgataatgtaccatatcagttaaacaaacaaactccaagcactaataaaacaaccatgtcctaacatctcatgtcaccaccacctccaacttgatgtgtcgcggcaaagatctcagcatcatcttccatattaagctgaagtcaagttacataaatataaaaatttaaactataagttagttgtttgaaaaaaataaagaactatacgtaaaaaatgagatctgatcgaatattacttctacacaagcagtagatgcacactaacaaagggaaatacggatgatgcacagctcaatattaattttgagtaagaaaaaaagttcaatattaattttcattttcacaaattaaagtgtcctatgagacgtaaagaaggtaaaaaaaaataaaaaaatccacgaattgaagtaaactgaaggggtattcccaaaaaagacaaagtcatgcaagaatattgaacagggcaagcctttctgatttcctgtacattttcatgtcttatttatattaatcataatctcaactaaataaagaagcaaaacaaatcgtgtgatactagaaagtatgaaaattaagaagaaaaaaccttatgccaagatactttttttaagagccttatgctaagcctaatctcctagaaattgaaacaagcaccaaacatggaccctgaacagatgaaaactgagcacatcttatgaattggttcaacgtatagcacagtaaaaaaaaaaaaaacccaaactttgtgtgacatgacatgttacgaaagaaactaaccatttttggtgtatgttttcccttaatgtgaataccatcgcataggaactgcattgtctcgtattccaagttctttcgctcacagaaatctttgaataccttaattaactccaagttgtgattcaccttgaagtacatatggcgcccatcctaagggaaacaagaaaaaaagatgagaactcaaatgttgtattaaattattaatatacaaattttaggcacgaaaatggttttaggagttataaggttgttttggtgataaaaagagaagaaaggaagaaaaaagtggtgaattcaattttcccgctagcaaaaaattaacattaacaacttcaataacattttgcccatccaaaaaaaaggcaagtaatttttctattgattcttcaataagatatagggaaaggtagttttacttgttagaactttgaatcttagaatcaagagtttttccaaagcaatagttagaaaataaaggattattgtagaaaaagtaatgcatacacctgatctatgatagaaaaattgatttggatattatcagtagcctcattatcatctggggattttctcttaggtggtcgacctctggaggtagccatgttcttctgcacatgcaattgaaaattgcacaaaacattttagatgagtgggaaaatagaacattaattcaaacaaaaccacactaaagttgaagaggggtacatgcaatttgttttattcttgaatcggtgacaaaggaagagaagaaaaccacaccagttggggaaagttgaaactcttgattgatatatatggttgtggttgtaacttgtagtgcttctttcagttttctaataaaaggtgctaatgaaagaagttacgtgagtgatgtattgtttcatacaatttcaaataaagtctctgcgcggcacattttcaaattggtgttcaattgctattcttactgcagagggaattgattctctttgtgacagagcatgacagctttcaatgttgtcattctttctattattgctagtgcaacaagcctatactaaacaaaggtacttgaagttgacctgtgattaattaaaagcgttctcaatttctttaaaactttgcttttttatacaaaagaagaaaatggtaaaaataaataaataaatcaaaatataagcaaacttttgaggttctattttacagtgtaaaatgtaaatttaatcagaagtaaactttttatttatttatagggattgatttagggagtttagaataactcacacatcctactcaactaactaaattagatctcttaactagcaaacttttatttacattcggatgatgtcatgagaattcaaaaataaaacaaatacactgtgatttttacatagtttttgttgtatgagtaatgtgctgtctattattatcaattattgttgtgactctttatctaattgtaacttcttgtagtctaagagtcattcatctatatgtgcctgaaatgtgaaagagaaaagaaagaaagcagaaaactattcgatcagccaccaaaataccctcttgttctatttttctgcataattttacagtacctacagtccaccatatcctataattccttgagtgtttttggcaagttagcctgtgttatacacccacatacatgtcatgttatgcccatttctcttcattattcctcattcatattcatgtgaaaatgtgacatcattccattgcactatctacacttcaattacttattattcaaacctaagaccccttcccttgcactaataattaatgaactttaattactattttttcaaaccaatatttgggcagtaattttcacagaccaatcaaaagagagagagaaagagaaagtgcatagcatttcttgttttagatggtaccaaaaaaatcgttcctaccctaatgtaactttaataacagttctatcatttctataacttcatataaaatataatttttattgatctaattgttaaattatatttacatattgttaagattgtcagtgtcaaaattgaataacaacaaaaagataatcaaataattcatattctagtatattttaaaacttttatattatatcgattttaatctatatgaatgatgtagcaaataatttatgattaatatcaaattttgcatatataatatctatgtaatcaaataataaattttaagaaaatattatcatatatatatattatttctttttttgctagaatcttgaacacaatacttttccatgtaaaagtgcaaattcgggatagtgagcttggacacaccatgctggacataacatataaagccaataaaacacaacaaacacaactgtggaatttgaataaatgatcaaaattatatattttgaagaaattttaaaacttaatatatcaaaataaaataattataaaatataattgtcaaaaaatgacattaaatttaaataaaacaatagtagacgcgataggtattatctttaaagtatttgggggaaccttggtcctcggtggcatttaataataatgattttttatataaagaaaaaaatcattacaggggtaagtctgtctaacccttatatgaaatcactaccaagataataataagtacacaaaggtttaaagagtaaatgtgttagatcggaacgtaagagggaaaaaaaagtaaattttttcatcaaataaattattgtatataatgatgtttaaattaaaatagaattaaaaatataaatatataatattaaaaaatatcattattgttatataatgaagacaatatgacatcaactatgttaacaaaaaaaaactctggtgaaagatatattcattagttttatttcgttaaataaaattaaaacgataaagcttattataaaataaattattaaaatcaaaatacattattctacgtcttctaaattcatcgcaatacttcaaaatttaaaattcaaattcaaattaggatgaattaaatataagtaataatattatttaaaataaataaataacatacctttgaaatcaaattaaaaataaaaaaatgccacgtaactaataaaaatgataatactaaaaattctctcctaagtccttaattagtcttcagttttgttgagtacattagttactactacctctcaagtttaacatataagcttggtatacaaggagttaaggtgcgtattttttttttttctgataattaatgtaccatattagttaagcaaattaacaaactcgatccaagcaatattacaacaaccatttcctagctaatgctttcaagagtcaaagtgctgcagcaccacctccaatttgtgatcttatggccacgatctcagcatcatcttccatattaagctggaatatcaagttacagtaatataaaaaattaaactataggttagttgtatgaacgaaaaaggactataagtagatgcacagtaacaaaggtaaataggttgaaataaaatgtcatgcacaacactaaataaagaagaaatcatgaggagtggtagcatcattctctccagcacattcaattcattctaccacacattttactattgattagaagaaagacacattaacatagagaatgtgttcaaaagaataaattagagaatctattatattattaacatttctcaattatgaaatattagaaaatatatatgaacactaagaattttgtgtgacttcatatgaaagaaactaaccattcttgctgtatgtttccccttaatgttaaaaccgtcataaatgaacttcagcgtctcgtaatccaaattctgtcgatcacagaattctttgaatacattaattaacttcaaatcccggttcaccttgaagaacaaattacgcccatcctacggttcaatgaagaaaaaggtgagaactcgaatcttgtattgaattcttaatttaaaaaattagcttaattccatttttttttatgtctctcagtataacaatgtatgattgtaatctcataagttttatcggtgtcaattgggtctcttttaagtgttgcaatatattgtaggattttagtccttggttccaattgtgtttattatatctctcaaatatcacaattatacaattttaatcctccatgtatatatattaacaaaaaattggtgttgatctattaaacaaaggaattaaaatcatacaattatgatgcattaaaaaattcaattggcggaacgtgaggactaaaatagtaaaatcacatgcatataaaaaaaactaaaagtacaattagccctaaaaaaattaggcaggaacggttttatgcacagttccatataacatttgttataaaaaaaatatatcatgtaatatttgatgcatgaatataacttttgttcaatatgacaatcagtatctgtatagacattacaggtctacatcaacatgccaatacatatttatagaagattggtacatactgtttaatttatacatatgtgtagactctgctaaaaaattattaggaaaaaaaaaggattattgtggaaagagtcatgcatacacctgaagtttgatttttaagttgacagaatcatcatctggtggagattttctcttaagtggaccattagtagccatattcttctactgcacacacgaggggagagatgtaagatttcacaaacctaaggcaaaaccaaaaattccaccaaccatgagtttctttttgaatatagaagaataatttttttttcttaattatatttaaactataaagaccaaaaaactaggtctcattcccaaatagcatttgaaaatggcccagaaactattgagatgggtaggaaaaataaactgtttttctgtcagaatgtgaagcaaaacctccaaagccacactaagttgaagaagggtgggtacatgcattttcttaattttattcttgtatcagaaaggtgcggaagaataaagagataaaaaacaaaacacaccaaaaggacagagaagtgagcacaataactttttggtttcaaatgaaagccgaaaccattttattatggttgtgcctgtacgttagttgtagtatttgtttctgttttctaaaaggtgttaagaacgataaattaataggactcgagaatttattatgatccctattaatttttataacacatacaaatatttttttggtcttcaatgttattaattatttttttataattgaaaattctaagtacttatgatataaagattggttgagattatatacttgcggactacctaaataattttttcattaatgacagagaggttccttgagtagtgctgagtttcaattaccaacgagtcacaaaaaaactgattattcgtatgattagaaaacaagaaagtactttatatattttcaaggtagaacatcaaatttttcaccaaacattgcaatccacacatataatattgagtgagctcttcacaagagctatcagcaaattatttcaactgagtaacgaaagcaaatcaaacgatgaacctggcataaaaataggaaaaaacacaaaaataaaaatgaaaagtaaaaaggaaaaagaaacccacctgtaaaagagagggttgaaggcttgaagctgagataaaggctttcaagaaaaggtggaaggagagaaagacaaatgtgatgtttaaattaacttcttcaggtagttttttctctttcagaattttaaaatgaactgggagaaaatatattgctatttagcaaaggctgcaatttttcaaagctcctagttcccagaatctctctactgtgtacattttcaaattgatgtttaatatccaatgttacttttcataaggtgatgacgatatattgctgcagcctgcaaagggaattgattccctcttgatagctttcaatgttgttggcctagctcttctttctttagattttttatgcaagaagctacaagcctactaaattaaatgtagcttccgaaattggcctcttattaaatataagctctctcaatttattctgcactttgttttttttataagaaagaagaagaaaacagtacacctttgcgtttctatttaaattggaagtataaatattaccgtgtaaatttaattagaagcaaagttttaggctttcatggaaacaaattttattcatgttttgcttatctctagaccaaattctagattaattagtattttttgtcctaatgaatcgaagaataaaaaaatttaggctttcacatttgttattcaattaccaactggttggttagagtatagtggggagtggaagttgtctaacaaaaaaaatattattttggaatatcacatgtccacatgtaattttgagttgtttaaaatttgagaaatttatttatataaaccactatttttcatgactttgtattaaatataagagagaaaaataaaatatttataagtttttgtttgtttttttgtgaaaaaacatttacaagttaaacaacttgttaatagaaataatcattagagagaaaatcagttaagttgtttaagattaaaataacataaattagattatttatatcaacactgttggagatattcttagtcaacttatacaaaacctattttaaaattatatttaatttgatttaaaaattatatctatgatacttttttttactagttgacaaaataattttttcacttataatgcataaaaaaatcaaattaaaaatgaaagaaataagagaaaagacaatagaaaataaaaatagggaaattttactttatttgcttgggtaaataaaaagtgagtggaaaaaataaataaattatatgaaaaatattttattttaattaaaaaatgaataaaacttaaaagaattatactttttaggatattatttgttaacgtaatttttttttatattttttatgttacaagaagattgtattttaagaaaactaaaacaaaaaattgatgccattctcctactatatcccctctcgagtgtagagaatatattatatttttttctgtttttcttgaatagcaccccaaacgaagatgaatctttaaatgcatgttaaaattaaagtttacaaacttaggtcccgtttgaggtgattgtgagttgaattttttttcttttcaaacttagtttcaacttatttcaaaaacaataaaaataggtttgtgggttttagttgttggtttattctaacccacacttctccttcaccttgttgttcgtctctcctctaccgtggagatcagcaaaatctcccccttctgtgccacggagaccgacaacaccaccatcgaactcgcctctgcctcctccccaatcctcagtctcaccatcggaacacgcacaacaccctatgcatccattgtatccctctcttcatcatttcccaatcctttattcccacgctagctcatgaaatcctttatggaacgtgcgagctcctacacgatcttcctgccgcagtgattctcgacgaggaagcgcgtggcggtgacacgctgcgaggcactgaggagacagatctcatagaggagctcgacactacaggccttgaaagcgacaaggaggtcagggtcgaccttggagtggatgagcgagccacggacctacgcgccgacgatgagacaattctgcttgacgctaaagatgtcaatggtttcttctagtcagagaggagaagccctcacgaattaaggaagtaattaagggtgcgtactcgtacccaaggccgaggcggtgggcaaggatgtcaattcggcccaagatgtcaagggtgccaaattgcaaggggaagggcaccgggggagagcgaaaaagctagaagacttgatgctccgatgaccgcactgctaggacttcttgaaggaagtgagttaaggacgtcggagatgggtttcacaaaatagcaacggtgaggaacttattaacaacttctaaaatttcaaaactaaaactcaacactcaaaactgaaactagatttaatttttaataatttcaaaattgaaaacagaaaaccatctcgaacgggacctttagtttgcaagttgagtttacaaaaatatctaaaatctcacttcaccgaaattgaatttttagacaatttttctctcaaacatacttttcagggataatcaaacaaaaccccaaattaattttagtctcaaacatatttttagatcctctcaccaaaaatctaagcacaccctaaatcattattagttggtagtaacttgcaacaacggcacggatactaggaaatcaatttctatgtgaagcacattccaggaaagccttttcacacacaaataataataaaaatacaaaattaactgaaaaaaaattcaaataaactattcacatcacgtactaaaatcatcaaaatttgataaatcgttacatctccgtttctcatccgaagagggatttcattcttgatttcgcaaaatgtatgaatttctccaaaagttgtcttatacatgatatccttgcaggaatgcacgacattttatgttcttctcaaagaacaatattttcagcagcggtctatactctatttttttttttgaaagaataccaaatccattatagaaagtttgactccattttgataaaaaaaatgctacattggaaggtgcaccaaaaaaattgcacccggacaagaattaaaagaaaagaatcaaatttacaaggaagttacagacttacagtagagaaaattattagatcaagttgtctataaaagctgaagactggatagtccttaaaagctccctcaaattagccaatacatggcgtggccccaaagtcttggcatcaatgaaattcaaaagctgttctaaatcctacaatcagaaaatcacgagagaaacgagcagtaagtcaaggttaattaggactgataatgtgtacactgtacacagtactatatatatcagatatcgttcagacaaccacacttcaagaaaaaaattaatgagaaaaaaggcaccaagtatgagaaaccatatttgagttataatacagaattaaaagtctaagccaacctaccagccaacaccaatgcaaaaccaaaagcctgtcaatataagtgttaatcttgctactcaattttgggaacaggatcacctgcagttgtttgtaaactgcagggtcctgcagttaaaatcaaatggtctaaaatattgtaaggtgcattttattatatttttcagtgtatgtaatgcatttttaattggtgatgatttcttgacaatggaaattcaactgcagaacaatcataattatgttttttggtaggagtaaacctttgggaagaaaacatgagatgagttcttgaacagatgtttcttagaattaaagcatctcatgtaagcataaatcaaaaacaaacttctaatctttcatgtcatgaaacgaacaaaggcatttggctcctctagagtaagtaatctcagctgttgataaaaaaaaaatcaacggttaatatttcaataaatccacaattggttatgcacttatgcatgcacatgtaatatttactgttgattttctcattgacaactgagatttgttactttgccctctaaagtgaaatttcaaacaaagggttgggaaaacaaaaaaaatagaaagaaaaaaaaaactaattctggtggaggacccatcctcacttccagtaagctaacatacaggacttaattctcagagtaaaatggaaatctgccaattcagtctctcttcattaaacagaaaaacataaaagcaaggtcaaaataatttcttaaaatcaaccaacatgttggaaattttgggcagagtcccagaaaagtagaatactttgtcttacaaaaaacaacacaaaaatcatagccagaaagctaattgcgtgaaacaaatgggaagtaaactgctaaccattcaaaagcaaaacgcagatccggcaatcttgcaaaatatgtgtaatgtataaagtcatcaatgaatataaaaagtccatgatccaaacaaacaaattagacaaatgataaggggcagaaagtgtcagcaaaaaaatgcactaaattgttttctcaggagttcagaagaaaacaatgaacaagataagactatccctgttatgtattgccttagttcaaacagagcacttaaattcaaagattgagagtaactacaatgcaaatataatatataccttatttagtaagaaaacagcataagctgctcttgttgtgtcttgaccttctaaaaaaaggggaaatttcacatgtttggcatttatgtttgcatttgatgaagcttcagacgatgttagctctgttgaaggtgcattgtcaataatatatgaatgagaagcacccaaccgtaaaggatatcgcaaaggaacttgcaagtatgaggctataagtgaaacagcctgcgagaaaatcagtctagtaaagtacatttcaataaataaaaaaatataaaaagggagacatttcaataattattagctcaacggtcatccacatgagctacaataagaaatgctgcagctggaaacacagaagtttggtatatgataagaaaaagcattgacgattaagtttgccatatataagccatgtcaaaatatgaaggcttaaatacattcttcatccctgcaaatatactagttttcacttttaatcccagtaatttttatgtttctaatttgttaacattcaaaccttttagttttggctcttcccattagtcatgaaagcatttttgtaatggaagaacaaaaaactgaaggtttggacattataaaaatgtatttaaaccacgatctgtatatgacaatttagaaaccactatattagtaaggatgaaaaaggtatttaaaccaaatattatatgacaattaagaagttgtacatcaaatattttggaaatggatcacaaaaggcataagatagaataacaagaacagttctgaggcaaaaaagggccaggtaggttctactaatacttacatgtgcaacatatcctagggctgtagcagaattctgaatttcctttttatcagtgaaaaagctcatcttcctaaaagatagcacattcaaatgcagaccatgaattgttaaggatccttgattaattggtttaagtccagcagaagtccctgagtaatgaaatatatgaaacttttaacaataaaatccagagaaagtatcccttagaaatgcagtgaatattagcaaaaaaaattgtgatcatttaaatgagcagaagataaactatacttaacattcaatgaatagctatgatcttctcgagcatccaaaggatcaaccatatcaaaatctactgtaccaaactaaattataaaattacaatttaaggtcattgtcaataatcaatactagtgcagaagcatcaaagaaaagaacaagacatgaagcacaaacatcagacagatgaagtacagaatgaaagacaccctttcaacacaacagcccaacttaaggaagaactatatccaaggtgccagtaagaaattaagggatagtgattgaaccatccagtatctcaagtttcttaatttatttaaattgcaagtttcttattttgcatgacctaagctatttttttttaccttaggggcactatccacatagaaaaaagactattattgagctaatcgttacctgccaggctacctaaaggatatgcttcaagctcttgctcttgtgctggcccaaccaagatcttaacaggatagagcattgaaatttgagatgtcatatattgttgcctcttcctgagcatcttttgcaattttctcagatgaacataaccattttcttcagacagtaatctacttgattcctataataaaagcatcatcagccttctagctacaataacaccagtaaaatacaaacaataaccccttttccccaaaaacaagaaataatgataacttatttaggttcagctaaataaattcatcaatatcatttctcacacggactaatagagaaaaggaagcttttaaaaaatgaggacatttgaaagaaaacaagaagttcatttctgaaggacaggtacaagtggaacaaggaaggtatactctattcaattgaatataaattcagtcaaaagcaaaaaagaacaatactccaaatgtcaatttgcaacacatacttcagcatcaataaaatgaatcaatttttttaatcaatacaacaatgcattccccctataactactgaacattttacatttaattatgtccaggaaaaaaaaaggatattatatcaacaatcaactacaatatgacataaactcacctggagatttctgctggttacagaaagagcaccccctgacaccaaaagagattgcactgcaccactaagctgctcctcctgcttgctagcttcctcctttgccagcctagaacatatagacatattctccatcaacattttctttgattccaatttctgacgcatctcctcaagttcattcaaccgacccaatgattcagcattgacctgttaggcaggctcattaattagggacaaataaaaaaacaaaaaatcaaccatacacctatatattggaaacttcaacatggctgatgtcaactgaaaacagcaaataccgcaaaaaagcatcccaaggtgaaaacaaaaactaaaccactcaacaccctgacaagactgaactggtgtgctaaaataatcttagcagcatagttatcaatcccggataatggcacagagcaaccaaccccaaaaacggtcacagcaagatagacgatagtgggatgactactattacaaaatttattcatataattataaattaaataatgtgtgtgtgcatgcactctcaaaaacatatccataattaaaagtcataattttaagccaaacacagaagttaatagctagagtaaagagaaaaaatgtacagcaagaaagggcacaacagtgaaagaaagagaaaacaaaacacatacatgctcacatatatatacccctctttgaattgaatggaacagaccccaaaggatgtgagtagagaccacagaacaagagttccacagattgttagttggctggaaacacagttgagagctttgggtcagatggttaacatcgaagagagaagaggccaccccttttgatgtgaacagaacagactgcaaaggatgtgaacaaggtagagaccacagaatggtgtgccagagttccacagcttgtgggttggccggaaactccagagtgccatggtttggccagcaatgcagttgagagctctgggttagatggtttgcgttgaagagaaaagagactaatgaaagtaatttgttatttaacctttgaaaggagtgagagtgggaaatagtttgtgttctgatcaaatataagggggaaggggggaaaatcccaagattgcccctcataaacagcaccaaatgacattgttcaaggggatttcgtctttgatgcaatagcagtcgcaattcatgtcactccaggcacgacggtgagttgcgacatggcaggcttccatggagcagcccatagacatgacactctgcaacaccactatagcagtgctatagcgtgactgactacaatgttttgcaggatattctgagttggaatatgggaataaagcatttccctttgttcggatatcatggatctactcatgttgggcacacttaccagttaagatccaagatacgcaatagaaaaaagtcgtgacacaccaatgattgtacacctactcagacccactgataaaatttaaaacacaaaatgatccatgtaaaatcagaaaattattgctcttaaatcctctcccataaaaggtaaaatatgcctcatgttataatttataatcaaaggtatgtagttacttgtccttattctgataaaagagtaagattaaatggtaaatatttatattaggacaaaagaagtgcctggtcagagataatatgcgttcataagaaatcaaaggttaagaaacagactgaaaaatacacatcatcttagaaaaatgagagatcatccagtccagccataacaaacctcaacatcactaaacagtggtcgaggtctaaagcctcttggtcaccaactttaaaaccacaatccgaaaacaaaatggggataaaatagcctacgcataaaccaatggatccgcttataaggtaaaccctaatttgcgaacaggccacaagtaagtagtaataaacaaaaaataataaataaataaacagttcgcttctaattcattttcatgataaatgcagttacattcatctcccctccccaattccatttccttccgccaagaaatttcgtaatcaaacacagaacgcgattccattcgccactcgagctcacattctccacgacaccaaacgcgccgtacctccggccactaaattccaacttcatttccatttaattttcattcgttacagtaaactcgtcaaaaatgcaaacacaactcccgaaattcaagaaacttaggataacaccgtcatcgtaaacctggtttcggtatttagcaatggctaaacctaaaactaaaaccctacctggattagggactcgagcttgtgctgaagattccgcttcttctcgttggcttcgtggagtgcagaagagagactcgccaaccttgcaagatcgtgctggaagtcgtcccactgaatgactttcacatgatcgggatcagtcgtggtagtccgcaatgagacaatctggcttggtggttccatcacggatcgaactcatcgtcttcgagtgagtgagtgactgatcagggtctcaagctcttcatcgacccctcttctgattttctcgggaaaatgacgggagagaaggaaaatcgcgacttggtcttcgagaatggatgttgcaaaagttagtttttttttttttttttggattattgagccgcgaaatagtggacacgtggaaaacgttcgcggtactttctttgcctttgaacatttgctgcttgatccttcactccttcgcgtatttgaaaaaattgaagtggtgaaaaaattgaggattaatactcttttgactgagtattatactcttagatgtgtttagtggagaggaaaaaaataatattggaaaaaaatgtatttttttaattcacattttttttactttattttaatttttaagtttttattttttttttattgttcaaatcaaatacataattttaaatatattgtttttaacatactttctttcacctaacctatagattgtctccttctaatgcataaaagtaaaccatggattgtcttaaatagatagaaaataatttgatttactaaattggttgtgcattacctataaacgataaagacttgtaaatttaagagtttaagtgaactaattttaaagtttataaaatttctttcatttctattaaagaatataagggtccaaataatcttcaacatttcttgtgttctatcttaactttatgacatattagacacttagacatagagttaatcatatgtttttttattgatgatctctaatacattttttaaaaattttactacatcttgattatccctaagtataagatgaacttatctttaagagtttattcaaaaaaatcctggaggtttttcttcttatgaacgatcttccctttcttaaataaaattatatcacgaatcaataaagtataactttgttggttcacaagagatcatgaatcttgttttaaagatttatttctcttaattaacttcctaaggttgctaccaaatttaaccagtgcatcttaacgcttaaagcattgagaaacattcaaatacacacatttacactcttcttaataggtttacctcttacaccatcatacaagtcacttatttatttttttgaacccaaatttgatatgagtctaagactggtcagggaatcaaattcactaagacctttgagtgtatattcaatgacgtccaattagtttctccattaaaaataaaagtaacacatgtctcatttagatgtagatacgttgaataaataaatatgtcatccttaatggtgatatctctcgttttattccaatgatttaatgtgtattatcattacttctcaaaaagtaatatatgactctaagaataataaaagtacatcatctttataattaacaattagattctcaaatccaattgcaaaattctcatcaactaaaataaccacaaattagatttcaacacacaaaagaaagtcaccttcaaatccttaaaaatcttgtggaaacctcttagaaaattgtattccccaacaaaacacaacaaatgggttgcacaaaaattctcaacattttcttatcaataaccttaaataaatcacatccaaaaaaatcattccatgaaatttttaaaataagttgttctactcattttttgaagaactctaattaagctccaagcatatgtcattgttgtgttaagattttttttccaaaaaaaatgctagagctcaagagagactaattaaggaagttaagagaggttttcagaatggagaaataagtggttctgatgattttggctttgtgtaagtggttttaggacacacaaaccggggcgcaaacaggatagttcaaaacccattttttttttttttgtcaaaatatacatttccttcgtgcatataactaccacttgttattatcacaaccctgacttgagctacaagtgctagttaggcattctgggtggtgttggaaagttaaaagagagatctataagttgtatttgtgatagaaaagcctaaattaatctgtaaaatgatgcagaatttattgtaagtttgccttgatgtaatgcattttacacttaaattgtgttgagcttattctaataagcatatctcaagttttaaatgttgtattccagtcaaactaaaaatatatgaaaactaaaatagatttacaacatgaaagacatctaaaatataatttaatccttaaatgtgacgacattagagaaaataattaaacgcgtgagttgtcttttaacaagttttcatgcaactagtatttattgaatcagtcaatgactaatggactcacacatgcatcactttaaaacaacaacattaattagatttgtgtcctacaagataccatcctccactcctttcactcgaggaataacaaccactaaacacacaaatgggagttttttgggaaacccagacttctcaagcttcaagtgagccattaaaaatacacatggaaaataaatattgattagaagaatgctagtagtaagaagctcgcgtgtgtataaaattgaaaaaacttcacttgagctttttatcaaggatggtctttcttttcatccgcaatgagactttcatttccaaaattaaggagtacatgactacatgtcatatgattggtagtttttattctagcacatttattgagcaagcaactcacacgcgaactagcttgtcaaacatggatcatcattttttttcttccctttacaaatttaggaattttgtgccctaccttgtatagacatgcttaaccgatgtagtagacatctccacggtgagagtttgacttgtttttctttgttttcctaccagtaagaagatattattagcttgtttccattaaacattagatgtcaggttaataggtgaaccaaaattataaattaaaaaaatgggatcaaattaaaaaaaaagttattagattgtgaaatgatgttagtaatcataagggtaattaagaagaaaaatacactgtaaatacatcattttgtcagtgtaaattaaaataattagtaatttaggctaaacaaagaataactagtattttatcggtgcatataataaatatttttgtataattattagatacttattttatacaacaaaaaattataattcatatataagtcattgtaattaaaatttgtaataaaaaatatttttaacatgtaaattatattttagatttattataaacaatttacatggtgacatattatcattattattattattttattttaagaaatattcaaattaaagttataactaaagattttgaaaatgatagtttgaaagagatattgaattaaattaaatggtttagtttacattatcttatctcaaatgttgttagaaacgtatctaaaatttaaagataaaatatatatttaaaatttatttttgatatatatatatatatatatatatattatttgaatcaacaattttttttaatctcttatatcttttaatttattattttcactttaatcgtaaatttaattataatttatatttaaaaaatatttttatcatgaatttaattataaatttatttattataaattttatgcattttaattgtttatgcatttcacaggataaaaataccagttttatttaaattcataaaaaagaattaacttcgaaaattaatttgtcgcaatttttagacgtccaacaattaaagttggtattttcattttttacatgcatttatcattgaattagagggattatttaccctaataataataataataatatggtagcggtgttgttggcatctgcattttctacccgagaaagcaaaaagcccaagcagtcgtcttggtgctgccgattggtcaaaatatataaatccatttgttgaaatttgttactgtattgcattgcgtttgctgcacccatcaatggcaggcgtttctctcaagtgcggtgactgcggtgctctgctgagaaccgtagaagaagcgcaagagcacgctgaactcacctcccactccaacttctccgaatccaccgaaccggttctcaacctcatctgcaccgcttgctccaaaccctgccgatccaaaaccgtcagttccacactctccgatcaacaattcccgattctcattttagggttcaattcctttttttatttgattattattaactgaatctgttggttggatcatgaacacaggagagtgatttgcacacgaaaagaaccggccataccgagttcgttgacaagacttccgaggccgttaaaccgattagtttggaggctccgaaggtggatgcaactgcttcatcggaaaacccttccgctgctgcatccactgaccaaaatgaaggtagtttttagttttaagttgagttaattacaatttaatattcctaatctaagattgtaaagctataaaataaaggcgtaattattcgtttggttatcatacctgcacaatatttacgttttagtcccaatacatacactttttaactcgtattagttcttacacatacttttttagtgcttacacatacactttttaatctgttttaatccctacaggtttggatgccaggaactaaaactgattaaaaagtgtatgcataagtattaaatcgagtagtagttttaggtgtaagaagagacaaaaattggaacagaaattttcacccttattctttcagataatgaatgatggcattggatgtttggtttataagctcagtggttaatggtgatgtatttttaattggcggtttgcctgattgcgatttgtgttgtaaaatgcagaaatggttgttcctgaagtggacaaaaagctgcttgaggaacttgaatccatggggttttcaacggcacgggcaacgcgggcgcttcattactctggtgaatttacatgcagtcctattcttttgatattgaccatagctgtgtagtgctctttacttgttcaagatagtgatattctcttatttctagaattttttttctgacttgttttttgctgtctcatgtgagaagattaatagaggcttgtgtagtttaagtggatcaaatgctccatgtaaaagaaatagaggaagaaccaattaagtttaccttggtctgaagtgttttattgagaatatgatttgcaatagagcctagtctagtatgttgattgatcctgaagctgatcccacctagtgtgataaggttttcttgctattgttgcattttattttttctgtctgcctaagtgttataaatggtgaaaggccaaattcttccatataaacacgcctatggcgcctccaaaggaggcctctcttcacaagttgcttgtggcggttgccaatctgccatggtgctgccatttaacaacatcgttctgtcttgaaaattactttcttcttttgattggatagttcgtggaatagagatctgtagttattaatgcatcatggggcattatggagtatgttagctgtttcattatacgcatgacagtctctaggatacatgtcataagtagtcaatttatagggcattttcaatacaccattgatgttatttatatctggacattgataattattgagtctagatattaaacctgggttctcccttctacaggtaatgctggccttgagtctgccgtaaattggatagtagagcatgagaatgatcctgacatagatcagatgcccttggtacaatatttatttttttaatatcgcttattgtcattatttgcttaatggcttattgcttcataagtaatagatctgatgttgcaaactacaacacaaataagagtagttcatgttatgaataaatcttaaaatgtattcagtgtaattaagtcgcaaactctagttcctaacctgctgattaatgattcactcaggtacctaccaacaccaaaattgaggctcctaaaccttcgcttaccccagaagaattgaaggccaaacagcaggaactaaggtataaagctgaattcagataacattcatactaaagggggaagttatgaagctattttagggttttaatactgttatggacaaagttctagagaataattttagatatgcattgattcatttgatagatgtaatgtatgatgatgacctagggtaatccctaatctgctttcacctgacctgtaaaggacacattcgatgcattctgttatttttgtaagtatcataggctgattaagtgaacacctaatattaatatcattgtatattgtaccctgatttataagtcttgaagtagttaactgttagagattagaaatctttctgcagatttctgtgtcctctatcattgtgtgcaggttatatacttgccattaatacacgacagtattaatgctagccagaatccatgtgaatcgtgtcaatgtattgtgttctggccttctgaacttttgctcagttgatattgtcatatgaagatttttgaaattatgtagtttaacacatgcttacatgtgtccagaactatagtttacatgtggctactttttaagccactttattattactggtatatctgtagtctgtgtaatcattgattttttaaactataatctcaagggagagagctcgtaagaagaaagaagaggaagagaagagaatggagagggaaagagaaaaggtatgttgcagattcatccatttgattctcacttattacttgtgactttcattaccgatatgcacgtgtattgaaaatctttacataatggaatgtatgaggatgtgcatatatgtagattttgttagagatataaaaccaaccatgggtccttgacatggtatatgactctatgacccattggtcaaggaagggttccatacttgctgctttgcccacctggtcaaaggttgaatttcagagcaagatagagtgagcttgttagtgacattgctagcccaaatgactcttctgagaggcatgttagagatataaatcatttatgagcctccacttaagagcttaagcttttgggagagttggtcctcgacacatgatgtagtattgcttcaaaaatcaataattttttttgtcaattattgatttcaattatatcaaagtctatatcgtaaatgaactgttgttcctgtcatgtggtaagtttaggttgattaacagtaatggattaccccatctgtgtattagtatattcttgaattgaagtttacgttattaaatgtaaaaataaaataaaattctaggctgttaaaagtattttggaaagtgttattgttttcttttctaaattgtatccaaggtggtttgagggttttggtattagttttatgacccctttgttttagattttggaaaagacaatgtgtgcatgcacagaaaatgagatacttttggaagatgctcagcaccagttggggttggtagaagagtaatccaaacaggtccatagtcttattataaatgtataaggcttgtgtttgtaagttgtaacccaactattcaaagcacttttagtgaatctagtttgcattcccctcaattcatattaatcttttcctattagctttcatgggttaatttttgttgtgtatatgttctttggtcagaccagttaataacattgtaatatagtatttcttgacacatttgtccatatttgttaatttggattttcatttccttatctgtcatgtttttatgcaggagagaattcgcattggcaaggagttgctggaagcaaagaggattgaagctgacaatgagaggaaacggtctggctcagctagtaaatttattgtcgcacatcttgtgttttgttttgaatgcactcagctacaagaaaaaaatgcttcctcttgcaggttgttggccttgagaaaagcagagaaagaggaagagaaaagtgctagggagaaaatcaagcaaaagttggaagaagacaaggttccaacatttcttaaccattatgttctctcttgttcttttatcaaacctgttcttatctggctcgagagtcagatcatatgaatggttttttgttgggtttgcttttggaaggtggcaccttgggtgccttgtatttgctatactcagtacttctggtactgttatgtttctctattaataatactatacttttgccttccaaaaaaaaaaaatatgaatggtttttaattagaattagaatatgaatcccaaatacttaaatccgtgtccctgacctctatttgattttgttttaccttatgcacattaaatcttatttttgtcatttggctgtagttggatactgataatactttttgagatttgtttttattttccctcgtgatcatttactttgaaaacatacttttgaatgatgagtctttcaaaagatggcatgacaaatcaattatcttctattgggagatttgaatgaagttcctttgtttctctattatgacaggcggaaagaaggcggagacttggattgcctccagaggaaccctcagcagccaaaccttcacctgcacctgttgtggaggagaaaaaggtatgagcttggccaaaaataataatggtttcattttttttccccagctacatgtttatttgaaatttgtgcatgcagagttttgtgcctgttaggcctgccacaaaagccgagcaaatgagagagtgcctccgttctctcaagcagaaccacaaggtacattcttggggaaatttgggacctctgtttagttgacaatattaataactgtttgatagttgttaatgaactggtatcaattgaatatctaatggtaatagcataagaggtaccatagaagcctccatcacttgatgctaaatgatacatttttagtacaaattatgcagatagctttacatccaaaaaagtttttgccccctgaatctttctatttaggttcttactgcaagcgcaattgcataacctttttgtgttcatgaaggacaactggcctacctcggcttttgaaagaatacttttttttttgaaagccaagaaaataattttattagaatgaaaccaatactaggtacaagaagtaccagactggtttggtagcatacagcaaagaatacttacttttatatgcctaaatgttgcccttttattcagtcaactggtccagtgcatgaaagagagagggtgttttttggatagaagcgagcagatgtacatctggagatgtgctattgatgaatattagtgcactttaatagcatcgttaatgaattcactggttgtattatatctgaaacttcttttagcttcatagattatctttatgtttctcgaaggcaacaatttggttgtatatttctttgaaggactcaaatttatattctcttataaaaatcataaacttcttggtatgatttcaattattttcattttgatttctattgcttttattttggatggccagagaagtatattgtataccacgtcccatttaatctggaaaaatgaggccattttttttatatacagtagtgataacgttaactgcattttacattctgctaaaggaatttgattgcttacatcacagcaatgcttctcaactatcgtttgtctgcttaaatattgtgacaccttagcctatttacgtgttcacttattcttggagcaggaggatgacgccagagtgaagagagcattccaaactcttctaacttatgtagggaatgttgccagaaatcccgatgaggaaaagttcaggaagatacgtcttagtaaccaatcttttcaggtatatggccccatctttctcttgtctgaacaaaagcagggctttcaatactaacttaccgctagatcatttaaatacgatatatttatggtaagtctgtgtttatgttgggtgtgttttacaggacagagttggttccttgagagggggaattgaatttctagaaaattgtgggtttgagaagatcgatggcggcgagtttttatttttgcctagggacaaaattgagatggccgtcctgaattcagctggatctgaactagactctgcaataaagaatcccttctttggagttctttagatgaggcaactgttataatccagagtctcgataattatagtttcatgtttcgaagtctgagtgctaccgtttgtttattaaacatactgtttttttttttatttaccttaacttttgctcaaaggtatctatagagagatttgttacttgactgtcataagtttacgaggtttatacaaatttgtttcatgacttcatcttatgtctaatgattcagtttaagcagaatttataatgtaaaaattgaactagtgcacattgaatctaaagtttttaagacgctagaatttgaaagtttagaaaataattagttttttattgatgtattttatagaagtaactattaaattttgtggtgacttaaaaatcaattgtaaaaaaagcgtaatttttttctttaataataattattggtaagacgattttggattatattatatgaactatataatttcacttgtcctgtatttgaagggttttataattctaaagaattttaaattttatgaattttaattgtttcaattaaaattcattcatttttttcctttggataagaaaattattttttttttcattttcagaatcttgtgtttggagttaaatttcttattttgttaaacaatcaaaatatttgtctaaaatttctaaatcagaagtattgttcaattaactgttatagtctaaataaaatagaaaagagcatgcttttgtatcatcctttttcttgtatcatgtttcttcctttacgtgctcatcaagacgtgttagaaaataatttagttaattaatgtttttgttaacaaatacactaccaaattataaaatcaatactttcttgaatcctatatgcatcattaactacttttttgtcgttaataaaaaacttagctcattgaagaaattgtatgaatattataaatctgtattaccgttgatttttacgggtaaaaaaatttacttttttgtcactacgaacttgaatgcaatattaattattatttcatcccaatctcgaaaataagtaacaaaagtctaatgaaaaatagtttaggaaaaatatttattttttaattaaaataatacaatgtaataaaattatctaattttgttaataagtgtgatttttttctcttataatcgacagaagggagtagccttaaacattagatataaagcctctcattttttttcttcatatttacacgaatccgtattcacaaatccaattgcaccagctaccaaggatggtgctgtttcagtatttgttgaaccccagattcttttgacattgcaatcaacaatccgtgttgataagagcaaaatatccttttattatttatttatttgatagtcaatatacatattttgcctcgcacccattaaagagttggggtcataatgtaatttcgggactagaagtgctttagggatagtgtttaccaaaagaatgatatgaagaaggaattgaaaaaaatggcatgaaaaaacactaaaataaatcctttatataagctactgttgcactacttgtgaaacataatgtttgggaaggggacaattaagctgaactattgaattaaatttgagcctaacaagaatcacatcagtaaaggccttgctacaacctagctctgctctttcctgaataaaccatgtttgccatgcttaacatgttcataaccttataaattaaaatagtgggggatataagaggtagttgcataaaataaggttataaacaacaaaggctcgccgctttcaacttctgacaaaactgtaagcctggtccaagatcttacataggctaagagataatgaatataataagagaggaacataaagctaaaaaccatgttgctgttgcctctgaatgtgctctagaactgtctgggaatggagtgctcattccaggagttagtccaccagtgttgcccccaccaaagattggtgttgttgtggtagatgtaggcacatttgggttgttcattggaggtgttgtggttggtgtatttggtcctccagcagcactgaacatgataagagatcaaattgttaacttttagactccataaagtactaactataatttaagttatcaatgaaaagcattcccatggcttaacacaaaaatcagttcccaaaaactagtgtcttccactgaaaaacttatatttaaaaataaaataaaattgtcctttcttgttcttcaattgcacgatacacctccatggtgaagaaaaagttgtactatattgtaataaccatgtgggtgtgatccctcaactgatcaaaagcactcacgcataaaggttcatcatgacacgtgggagggcagaataagcctagaactcgactactatggccccatcattgtccctggtctctatcagcaattttcttacatgccgagtcataatagatcaaaaggggtcaaacacattccaagtaatgatttgatcacaactagcatctttattatgtgatcggagccctccattgttgtgtacaacaggcatgggttatgtctaggtgcagctcttttttagcacattaattaagtacacttgcaaatcaaataaacatttaaggtgattatttagctcaattcagccagtaaccaatcatttttactgagtacctaattgtaattatccatctaaaaattcctttcatgtaatgtaagttaccctactacagtactaccaaaaccatatcttcaataagatactaaaaaaagagtcatgtcaaatccttctactatgtaccttgtatcttcttctttgtctttctttctttttagaaaacatcgagtaaaattttgatgggctaaattttacgtgattgagattaatttacatatactttttaatcacgtaaaaaaaagtaatgtaaattaatctcaatcacagttttctatattcaaatatatgtctcgatgtgtgaaatacactgagtgctgaccaaatatgtaccaattactctttaacataaattaaagttggtgtttctacaatgaattataccaaataaagattcgatttttttcgaattgtgtctccatgaactacactactaccctagatgaagtaaaaagtcaattatagcttttctttcccacctcaccatcacatgcaaatggatgctataacttgctacaaagacaaaaagcctcagaaacaagaattagatgaatggacaaatgaaagaaagttgtaatatggatgaattgatggatgagaatatttcacccattgatgaaatgtgcgcatctaacaatgctcatatttatatggaaatgtggataggatcatggatgggtcaatttcaggattgagaaagaacatctgaacaaggtgctgggtatggcattttccgcagattattatttattaatggtaaagaaaacaacagcttacataaacgtctgcatcaattactgctacactacacagttgcatcagattcccagagtcactttaccatgctatcaagcaaaaaatatcgcacataataatgttgtatgattcacgagtgtgtgaagatcaacaacgtacgattaaggtgaacctgagccgttggatgaagtgggccacgcagaagactcatccaacggtctaatcgcaaagtgtagagtgtagaaaaagtaaccaacacactctgggagagagcacacaatgtgtcagtcaaatagtactagtaccactcaaccaaaattgtgcaacccaagattttgaaaatttgaacttcgaagaacgaagaatcagacacagagaacacaaattgcgtgtttggttccaattttgaaatttaattggatccatgttcatatggaagctactgagagtagattcctttgtttttattcgattttgagaacacaaattgagtgtttggttccaattttgaaatttaattggatccatgttcatatggaagctactgagagtggattcttttgtttttattcgatttgatgccgtataaaaggatatacgcacattttttatgcccaaaaaaggttataagaatatctttaacatccatccaaacacacttggtagcataagaaattgattttggtattaactaacttcaaattaattttagcttcaaatttgatattataatatatggcatcatctgtaaaattgattgaaggaggcacacaaacaaggcatatttatacacttaactgtgattatatcttttatttctgaaaaatccaaactttttttactcaaaaacggtaaagtaaaaaaaacttgggtaagtgcagaagataaaacaaagtttcagcagaaatggaggaaaattacgttacccacatccatgcacagtgacaagcgtcataaaccattcaaacaaacattctctctctttcttacaaacaacatcctctccaccattcttcggggttccatgccgtctctatcgtatattcgtattagggacgccatataaaccagacaaaagaaaaggtacaaaagagaaagaaaggtaaaaataaaaataaaaataaatgctgagaatgagaatccatttacttcaccatcaagaaacacaataggtttcactttcaccaatggtaaatgcactctacaagccacactcagtaaaataataagcgtattagaaacacattttttgtcacgctttttataagaaagacttgttattacacaagagttaagatattcaatagattttagagaataattagaacattactttaataataatatgatacagtataatattaggaacagagaaaaaggccataccttgcagaagaagggtaaacacaagatccatagcctacaaacacaaaaaaaaataaaaatgagatcacactgatccaataaaaaaagaaagaaaatggaaatgaagagaaaagttagttataatactgggatcactagtggcaatggtggcagtggcagcaaaatcacatgaaccaggagctctggtcctgcgctggtagtagctgttgaaggcataagaagcgtgagcttgaatggtgttagggagaaaacagagtccatctggttgaagaggaagacaatccccaccggccccacaagcatagtccaacgccgtttgcagtgcgtcgctgctggcgtcactcctcgctacacaccagctcgctgttcctccttgacccaacacattcttcgttgttgttattatggttagtaataacaataaaggaaccagctttggtgctgccattggagaaagttgttatattgagggagtttgctagctatagctgtgattgttttgctttgcttggttggtaaaggtggagagagagagagagagagagagaagtgtttagagaaaaaatggaaaattatattatggtgagttgagggaatagaagccgctttcgctttccttttggcttccctttttctttttatgagatgagatcagagcatgatagtgtatgtatctcaggtttctatgttctaacgttaatgtctgtctctctctgcagtgtactttacacgcagcatgaaaatcaaatcaaacctcgctcgctagcttctcaaatacaactcccactgtctctccttctctttggtgagaaaataaacacctaagaaaaataaaataaaaaattttatattttatggctctcaacttttctcaacttttattatttaagttttattttcggaagttttatcattaaaatttttaatttttgtatattgtattataattgataaaaataaatattttaacatcggtttaggtataattaatatagaaaaattatttttttatattaattataaccacaaccgatataaaaaattatttatttatataaattataattataactgatatacaaaaatttagaaaaataaaatttatattattttgttattaatgttatggcaaaatgcatgaaaataaaaaaaattggatgataaaatttgtaaaatattaaaagttagatgataaaatttataaaaaaaaattgaatgataaaatctataaaattatggaagttaagtactaaaacccgtaaaaataaaatttaagtgataaaattcataaaatattcagacatctttatggattttgagtataataatattgtaaaaaaataatatcatgataattttattaatttttatgataattattttaaaagttatatatattattatttgtaagtaattaatcatgtaaaaaaaattgacactaataatgtatggaaattagtttttttaataaaaatttaatttttatgcagcgagcttgtaagaaaatttatactgagtaaaaaaatcattaatgtattttttaaaataattattataaaataaataaacttatttcatgcatcatcggtttgaaatttgaataatcgttcaatttataagttaaacatgaatgaccataaagatatggtttcactttagaaactacattgaaaaataaaaacacatgcataatggttagtaattaaatgtcagtataatatttttcataatttcacttacattattgagtttaataaatatgcataactaatataatttttttatattaccaatcaatcaaagatcactcttagtcatacatgactatatattgttagagtaaaaacaaattaaaatgcatatatgtcatttattttatattttctacttgtattttcctcctaggttataaaatttgtcataaattgataaatgaatagcattattaaatattaaaaataattcgatgaattttaaataatttttatggaaaagacaaaatcattggactttgatggtaatttatcaccctttaattgattgattccttgatcttgaacaacaaataagatggaaaaggaaatgatattgatcttgaaagcattagagaaattatgtctaagaacttgaaagcgatctgcgtgaggaaaacggtaagttggtcggtgagggtgtggaatgtgtaaatctcgtaaaggattgccatcagcatgttcctgcacaaaatgataattggctgcaatgtgtttcttattactttgttccgtagaaaaaagatctgggtttgcatattaatttaggtgactataatattattcacacaagattgatgggtccattaaaatcattcaatcctgacagttcatcagctacggttaaagcaaacgggtgatactaatttgctttcgtttgatgcgttcgctaaatgaaagactcgtctgattatgagaactgaaacttgcaaaatatgaatagcagctatttgatctagctagccctacaactgttattcttgcccattgctattccaataaatgtttaaattagttattaaaattggtaaagtttattatttttagtctctgatattatcagtttgttaaattaaatgtttggtctagatatttgctaacagcctcaataacaatcaatatattattaatgctatgaacaaacagtaaaagattttggtttaaccaagggtaaaagatttttgtttaaagctagtgttaggaaaaaaaatgtccctagcattcctcttatctagcggcttgtaaaaaaatttgcttttagaccgaagagtttctaaaggtccacaaagttgttagaacaaaagaactattcatagtccaatagaaatatgggcaagctcattgagataataataacaacgcattacctataatagaaaattcattaagcgataagtttcctattataaagaccttaacttcaagttcgtaaacttataagtataactcctgagttgtactatatattttgtatgacatttgactgaagtgtaatatatgcatgactctgtgaataaaattaattactttaaaaggacattgatgttttgtacaattgcaatagaattgctcacttttttacacaaaagttcagttataatgtccttttcaattctttaaaatgcttatgtcagctacggtcaatctttgatttttttaatagagaaacattttttttacatctattattgagtgaaccttataataatttattctttgacatttattattgagtgaactaaatgtaaatgtcataaagagttactgaataagaatatatatatatatatatatatatatatatatatatatatatatataatatacattcttaacatttaatgttcaacaagttaactgaataataatagaggtacctactcgcctcggacattttacttgtggagtttctggttgaccccctattcttcggcgcaaaatctgcataagtcagttccttttttttttttgtttccttttccacattcttccatcacagtgaaatgagtgaacaagtgattaaaataaatgaacttggatccactaggaattataaatgacttaaataaattttgaatcagattatgattatcgattcgcttgtttaagttttctaagagtatataaaaagtgtttcattattagagattttatataaaaaaaaaaagcagaagttgtattttgtttaatagagtgtttgataactcgtttgcagcttccggacgtgaatcaagcataagttacaaaggatagcttttgtgtcttttactacttttttacgcggaaaagtggctaaacgtacgtaaatcgatgatgccaacccaaacacgagtcatacatatagcaaattctttttattttaaaatgtaggagttgtttaaataaacatatttaacagcttaacgaagcacttaatgaatatgtgttaattatcacgcaaccattcatgttacaaagttgtttttataatcgaaagaggaaactaagaaaaattactttcatgtaagttataagttagtttcataaactgtattaatgaggttattataattaataaactgacaacagagtataaattaaaatatctttatttatttatagaaattctctcaatacaaatgtttgtatcataaaataacataacaggtagatcattcctctgatgttattgagattagcttgggcagtattcaatcctccttgttggtctggtcttgtaatgtcttgctgttcattggaagccccgtgattgttgtatcaactcctccatcagtgctgaacattaaaaaggaagaaaatctttgtcataatcataaaaaaaaaaaaagagtgacaagagatagcaggaaaaattacataatttctttttagaacaaaaattaatttactccaagatggagcaaaagaactaaacggtttgaccaattaaaaaaacattacaaaaaaagaaaggaaataagccataccttgaaaaaggtgggtacacacaacgtccaaagcctaaacacacataaaaacaaagcagaaagaaacaatatatggttaatcaatgattttcacacatataaatagagagaaaagggaagatatatatactgggattagtaacggcaatggtggctgtgccaccaaaattgcatgcagcagggtttttggcatgggtctgatagtagctgtcaaaggcataagaagcatggttttgaatggtgttagggttgaagcaactgccaccgggttgaattgccctgcagtcagctccatgtgagcatgcaaaggccaaccctgacttcagtgccccgtagccagcgttgctccttgcctcgcaccacaatgttcatcatcatcatcatgctcccaactactattaacactagagaaaccacttttgctgcccttcaacaaattactattaatattgtttgcttaactggtaaagaacaactgattgtgtgaggatatttgttcagcacaaaggaattaaatttatagtggtcgtggacactttttttttttggtggagtaaataagcatatatcattttaataagagaaacgctcctaacatgaatcatgaactttttttattctaatttttcttggtgacggtggtttcaaatttttgtccccgagatgatttaatacagtttacatatttataattcacttaaatatatttttctacttataacttaatattttttctgtaattttttttttcgttttagtcattataaatcatgatggtttattttttattcttaaaatgtttttagatagtttttcttagtgtaaaaaatattatttttattgtttaaaatactattcaaaatattttaagaataaaaaataaaataaacatattttgtaatgactaaaataaaaaattcttttttacatgaatgaaaataaataaaaaatatcaaaagaaacaaatatgtatttaagcctttataatttaaatcggagcccaatcagttatgatagaagaatccacgctttcggtgatactaatacttctcttataataaattactatatttgtcagatatttaaaaaattatttctgattatttatgtaaaagataaacaatcaattcattaaaattaataaaaataattaaattagtctatcttaattaatgcttacaaaattttcattttattttggaaatttttattaaatataatgagttaagtaagcgttatatttaatgatgttgcttataatttaaaagttaatttttttttcaataataaaactattaatgcatttattcacttaaaataaagaatgggtgaattttatattaataaattttacaataaacagtcgtcagcattttttatacttaagttccgttataactgccctgcttaattctttataaccgtttcgtttgcaatgtcaaatggtcaacctttttcgtgatagtgaatatattaagaatataataattttttacgtaaaaaaagtatataataatttttccgttaaaaaagatatataataattttttaagagtttaatatctatatattaattacataaaataattttatacagttatatgatcacaaattattatttgaattattttaaaagtaaaaaattatatatgattaattgtggttagatcactgtataaactttttttacactttttattcatgacctttttcctactttttaatacttatactcttaaataaattttataaccgtttcgtttactgagacataatcttcctctctgtctctcttttttctcctcccgctgccttttctcaatttgcatttcctatttccagcttcagtttcatacctactgatgacctataataaatgaactttagatatattagttttttttttttcatcactattaaatgggcaccgactctttttatgttcagtccagttacctacgaaatagttaagccattcatgtcctttattttaaaaataataattaattatttatttggtctcactatgatctacacaatatttatgttttattctctatacttagaaacaactcgaatgagtccccatacaagcaaaatctttacatattaaccattgatgttaaatacaatttaacatcgttaatagtgagacaatgtagtgttgacgtaagtgtttgtattttatgttttagtttgtatacttgtactatttttacgatttagtctctacgtccattatctttatgtatgatcaaattttttttatatcaaaatagaaattaaggaaaaatagagacataatttgtttaatgtgaaaaatcctccaatgcaagggtaaaaatcacggatcatccagactaaagaaataattctactataatcaatgaagatacaagagaatctctaacaagtacactaaaacgtgttacaaacagtcaaattgaaacaaatcctcacttggtacaatagagacaagaagataaaactcaaaaatataaaacaaataatatgaaatacttatctctctttacatatatttgttttccgatctaactggataatttgaaatatcgcgtgtgtagagcctcctgtccaaaaattagcccgattcaacggtgaacgaatccgcagttgcaatctgaaaaatgctctctagtgtatgtgaaaatcacaataatttcccctctccttccttctctttgagtgatttataactgttctttcctctcaaatgagtctctctcagtgtgtatctctttatatgtgtctctctctaatctgactcctctctacttaaataagtgagacaaaatgagtctttttatttgggtctttactcaacataggaagagagcccaaaaaactcaacaaatctccccctcacaattatgtgaaggtgactgccaaaccggcagatctcacaagaaacttcaaacttccctcttattaatgccttagttatcatatcagcaccattatcatcagtatgaattttggtcaactccaacagcttagcatcaaaagcatctcgtatccaatgatacctcagatcaatatgcttagaccttgaatgaaaggttgagttcttaccaaaatgaatagcactttgactatcgacaaacagtagatatttatcctgaacaaaaccaagctcctacaaaaatttcttcacccataggaactccttgcatgcttcgataatgacaatgaattatgcctttatagtagacaaagttacacacttttgtagcttggactaccaagtcacagctccccctgcaaatttaatcaaatagcccgaagtggattttctagaatcaatgtctctcgtcatatctgagtcagagtatccaaccaaagtaggtttatcaccaccaaaacaaaacctcatatcaacagtaccatgaagatacctcaaaatccatctcacaacattccaatgctctctacctgggtttaacaagaatctactaattgtaccaacaactataaaaaaattatagcatttttatataaacaactttgatcttgtgatagttttaaagagccttacatgacatctgataataaggactaaaacatatgaaaaaatttctcacatcattaaatgttttaataattacttttaatttatatatatatatatatatatatatatatatatatatatatatatatatatatatatatattcatatgatgtattacatttattaaatcaaataagtatattatatggtaaatataatatttaataatattaccaattttaattgtatattctatttaataaaaataattaatgctagtcaattttgaatacggattataagctaatttttaaataataataaaataatttttatataaaattaattaatatattattttagatattaaacttttaatattttttcatttagtttattgattttttactatacatagattcatatgatatattacattcattaaatctaataaatacactatatttagtaaatataaaatttaataatattattaatgttatttatttattaaatacaataattattactatgtaagaaaaaatcactttcaaatatgttttattggctaatttttaagtaaaataaaaatagctaatattttaatatatatatatatatatatatatatatatatatatatatatatatatattcatatattaactttggttaaaagataatctcattctcgaaagtctaaaattcataagactaaccttaagatgtagaaaatataataatttttaaggactgtttttatttaagaacatattttaataaatatttacatattactaattgtaataaatttattttaataatgtttttaatgtttagtatatattattatattatatttaataatattgtaatcaatagtcaatacaatataagaaaaaatctatttatttatatgtctatgtaagttatacattaatagcatttaatgttatattaatgtatattttcaagttgattttacttgtggatataaatataaataaaggtagtaaattagcatcattggcttaaaatgttttattcatagagactacaggtattttgtagaaaacaattctattttctatgaagaaaaaaaacaattctatatgatttgagaacaattgttatgagctacacgacttctccaattatttaaggaatttatatatttagtattgaaattggagaggaattgaaaacaatagtaaaaaatttataatactaacacactttattctatcattgaattagattttaacttaatatcactcattaaactgaaaaaattctccactaactgatccatgcttcttttttttttttttttataaagctaatccatgcatttaatagttgacttaaagcatttgcattaattgaatggattttgttgccacagttaaacaaaaatctgattttatcccaaagtaggcgtttaaagttaatgaattgccatatgcagcctttctttgtgtgaaagcttgatgacatcacggcttataaaagcagaagtacagaaacaaaaaagataaaagtaaaataaaagtagaagttcttgactaaccttggctaaaattgtttgtcctcgccatagtttctgtgttccaaatcgtttgggtgagtttcttacgctttcctgcgtcatataattatatatttctcgccccttataattaactattctttttacattgcatacaattatctttgttctttatatatatacacgcacgtacgtataaataatgttgacccctggattcatcattttgatatcaatttaatccttttttcttttgaatccacaggctggtagggaaggatcacttcttctcggaggtactagttcaaaacttctttaaatttaaacttttttatagcttaattagatggaaaaaaggaggaaattaaaagaataatatattatctggttgatgttgatcacgactcaaatcttgattacattaattgctcagaatgcggaaacgcatgtgagtatcgttgctcagagactcatcacaggaagccatgtctgttcttctgcaacaagtgttgtaagacatctttatgtgtcccatcaggaacctatggtcacaaggaggaatgtccttgctatataacaattggaataccaaggaaggaaaacccaagttcccttaattaatttaagatcaatccttcatatttacatggttattaattctatttcatggatgtatttctctgtatagctcaaaagatagcgaaaaaaatatgcatgaattaaagttaatagtattataaaggataattagaaatgtcatgaggcaattaacagctagagactgatgaaaagaattaaacatgcacggcgctcatataccatatcagaaattaaactgtgtgtgaatatgttgctgaacttctgttccggaaacattcagaactacttaataattttttcttgtctatatatacatttatatttatggctaacatactgcaaaactgaattgttttttttactaaccacctaattcgtgattataaacaaccaagcaaactttcccctattgatttttaattatgttaaccgcaagaactttatttttggtgggtcattgaagatgatattaaggacagattttttaggacattgcttctctcagtgttataccatcacctccttcaacgcccccttctgacatcaaatttaaccaatatagcacatttggagagagagggtaaggtgatggtgattcaaatcttaattcatgcatgcactctctatatgctttaataatgataggcgtgagaggccagctgagatcgttccaaggcaataatgatgcggatgggaaccattattatagaaaactgatacttgcgccacaaaaagcctcagatctccacacatcaatcacaaatgcttctccatggactttgttctgttgttgttactgttacaatagcctctcaaattagacattaaggtaattgagagtgaaactatgaaagggtaaaaaggaaataggaaaaaagaaaaagaaaataaaaaaaccacctatttattgaaaaaaatatatatgttgggatgtggaataactttctaagttaaaaacatccacttaagataattattatcaaaattaataaatttataagatataataatttataattaaataagaatataaaaacattttacacttcatgtcctatttttcctaaaagaaactactatataaaaagtaagtttaaaccatgaagatccaattccaatttatatttattcagtagctcttaaaattaaattcttattagaattttgttaatcctaatttatagactaatatctttttattaaagataagctaaatagtggttataatgtttttaggctctaaggactttcattccataaaaattaatataaaatcctaaactcggcatggtacatttatatatcagtcattgtctgatttcaattaaacacccccacctaccttcttttcatgatcctctcatctccatgcatccatagcaccttgttctatagaatggctgccttgttttcaaactagaaaacatttcactgattccgtggtcgatctcatttctctggaaagttcttaattactagtctttagtacttcctagttagtactatggtcagaattaaaatcaatatttctatttgtatgcatattgaatggaaactcttgaaaatatttcactttacgaaaagttatcaatagtatttttcttactgcacctagtccacgaccgtgtctaaacgattaaaagtgcaaaaaaaaaaaaaagttggccttatcaaaattaaactatcataatttatttatttattaccactaacactatatttattatatttattacaaacttaaatacatttacggtactttaaccgattattcaggcactctctctttaaccaatgaaacttaacacccaaccaaatggattaatattgaacccaattcaataaaactagtttaatgtcaccgttgtatatgattaccaaccctaccaccagttttgtgatcaatgtgacaaagccaccaccaatcaccacctaattatcccttcgacatcgctgtcacgccatagttaattaccaccactctaccaactttagtatgaagaagatctgaacatgtatttagtataaataaatattttttagttgtattaaattgttaatttagttatatctgcaagcagttttttatcatttcatctgatcatgtaggagtatatatattctattttttacttaaagttgggattgaacgcccaatcgaacttgaatttattagaagaaactaatcttcacaaaaataataaatcacatcttttactaggatggtgatgatgaatgactccagttagactcgaaagaatattgagatcctttagttgcacattaatttagtctacgcttctaaagcagcctttactcctttcacgaatttattgagttcaaacttatttattgtttaattattattctattttgagttcaatgctgcattgctgctttcttatttaatatttactattttttcaatgctccaaaattataaggcacagtaacatttagtactttttcttattattcattaaatactttttttaaacatagatgaaatacttcagatttaattcatataaacaaaaaaaatatatgttgaaagaatcattaaactcggattaaaattgaatttaaaaagtttaaaaaatcactattaattatagaaaatcttaaaaaaatattgaaaatgattaagttattctgttttagaacacatgtatattccaatgaagacaatcatgacaatttttttcaagtagttatttagaacaatccgacgtcagtaagtattattttttttttaaaagcaataagtgttatttctgactattatttgttcacaaaagcaaaaaaaaataaaaagtaataaaataagtgttttggtatttattaaatgaatttaaagaggataaatatacaattaaaaaaggaagtgcaaacaaatgtagttacgaccgtgcaataaagttggcaactggcaagcaagcaaagcactagaaaaactaggaagagagaagaacccagttgcaacactaattttctctttccctttttttggacttatccttctttctgcaactccaaaatgggttccaaaggggcaaaaaatctagcactctcttcagccttgttgctccttttggtcggttttgcaacctcagacatcaatcaagacaaagcagaatgtacggataaacttcttggtctagctggttgtctttcctatgttggtggcgaagccaaagtccccaccatggattgttgctctggtatcaaagaggttattaacaagagcaagaggtgcctctgcatcctcatcaaggatcgtgatgatcctagtcttggcctcaagatcaacgtcacccttgctttaaacttaccagatgtttgtgaaacacccactaatataactcagtgtgttggtaagtagtctataactatatgcctatctcttcatgatcttttttttttttttttttatggataaatgttaatagttaattattttgttagcatgagaatttgaacctgtgacatctctctcattttattcttcctttatgattagatcaattttatatctttcattcatcgcacttgttttgctacccttatgttgtgcccgtactcaattttgatgtttgatatgttgctgttttcagatcttttgcatttggcacccaagtcccaggaagctaaggtgtttgaggggtttgaaaaagccttgaccaacaaaactagtccctccccggtccttagtggtaaatattgttgattaatttttattatacacaattccacttttaattgattcctttaaccctcgtggaattttttaacctcatcaaggttttaaagtacgatttgtggttgtggtttcggctcattgcaaatgcataaaaaaaatgatgttattgtaaaattggccattttttttatcaagaaagtccaaccatagaatccaatttacacgaatgaaaatacgaggaaaattatagaattgtgatagttaagagaccaaaatataattgtactgtctgatttagaactgaaaattgaccgcagctaataacacaactgcaaagggaacaagcacaagcgcgaacaacaacagcggaggtgggtggggaaagaggtggttagtggcagaggtggtgtgtgtgattttaccgattgtttttatttcccattttttcttgttcctagtttgaaccgtgatcaagagtagaaggatgatgttttagtggttgtgtctatttattatttcccggattcatgacgtgttctgcatatatatatgtttatgttatgcaatttgtgatttatttttactaggtgttgtactgtctgtttcctttagttattttttgcctcagtgtgtgcccatctcctgctgtctgcgtgattaattctccaactaattaaaaccattgaaggggacccgtcacttgacctcaacaatgtgtatgctttaaatatccttctgctagcatctgctaggaccttctatttacacttggtattatgtaattggtaggttcgatgttgacatcttttacagtatataagtgttcatttatttatttagtcgtaccataatgagattaatttggcattgaataaatgtaataaatattaagaaaaaaatggggttgaacatgtaaaaagaaatattcagtatatgcgtaatcttttttaagaattagtaaaattttataaaaaaaatattttctatttttttttaaaaaaataatgaatcaatcatatcattaaatcattacttagtaatttgtacgcgatcctaaaatcaagcttatttaccataaaagaaagtgcatcattacttattgcaactacctgcaacgaggatactcacacaatgtgtagttatagccaagagtttttcttttctttttttcctattaggagaatctcgcgtaattacataattacattttctcataatatgacttaatcttgatttttaaatatatatatataatactctctatatgactgcaaatatataaacatttttactgcaattacataatttacatgactttcttttactgattatatacattttcttaatagtcgctaaagatatttttaatcaatagtgagagattcatctttttcaaaagtatagattattaaagtagactttgcttactttaataaagcatttatcatacatattaaaaaaaatgaatcataatcagtatgtttatgagatttaaatcatgtcaaacttttttggtaaaaccaaaagacctaatgcctatttttagttctgcctttttattgaggatttagcttatttaaaagaataaaacttaaatacaatattatagttttttatagtattatttttaattaaaaccagcatttcattttgatatttaatggttatattgttttcgttgtgtaaaaaaaaacattatagaaactagttccataatgaattaaaacataactacgctacaaaaattagtttttgttgaagatatatttgtcaaaaaaaataaagataaaaaaaaaacaggcggtacaaagaataaagagggcaatgtgagtagcatcactcggaatgccatatggcccaaattcaagaacaaggttaatggtaatgtcatgtttgattttatgttaaagaattaaatccaaatttaaaattgattatagataattattcacatattttattttatgtcggagaaaaattcataattaattttaaattgaaataaatttgggtaacttttgtactaaataaaaaaaattatactaaattttactcataacttatttttacaataaaaagttaaaaacattcaaacacaaattatcttatttcaaaatcaattttaattaaaattaattttattaatgctcgttcaaacacgccagaagaagaattttcaggcccaacattagacatggcaccaagtcaaggaagttagcacctcccccctgatgagctactaaggacattttttattatctgttcaaaaagtaattttgggtgctaaacttatttttgaagagtaaactcactttcatgatcttcaaaactaagttttataaaagtaagatttaagttgtttttgtaaacttaagtttaaaaactttaatataaatatgcatcaagggtatatttgaattttttgagagaatttcaaaagtacgtttaagaataaaatcagttgagaatcatgtttggttactctatgtatgaaagtatatttttgcttgaaaacttagtttgggagaagtaagacttgagatattttttcagacttatagtttgcaaattcatgtttaactcaaacttaagtttgtaaattttaataattcaaacatggactaagttggaggaaagtatgagtctaaaagcatacacaatagtaatatagtatcctaaccaaactggtgcgagtgtcctgcgtaacatgcagtaaacatatttaaaaaaaaaagtcacaaatagtccattatattacagattaagtattaaacttttaagaaaacactaggtacaaatgaggaggttatagtgatttcaattatattcaatgccttgtaaatcaggaaagtaatcaccctagtacacagaaaagatcacgtggaaaacaatagagggtagtcaggtaagcgcagcatgcaaatcgttgttttagcaagaccctactttggcattcattattaagcacgtttacaccttaccagcaactgaaagttcagcaacatacatgaagttgaagtctcaacttaaatatgtacataatatcatgttcataaaggtctcccgtggatataatataacgtaaccagactgggttttgcgagtcttaacactttgacagatataagctaaggcaatagagggacagtgacaggttaaaacgtcatatattccattatgccatacaacagctagtatgaaactggatctactccgtgagaagcatgggaatttcatcgaccggagcaggaagctgcaaattgcaaaagatttctacaagttagtatttctctgactgcatttagaaaaaatgtcaagactaaatgaagaaggatatgcaagggaaaaaggttgcagatgatattaatttgtatgatcatatggacaaactcaactagtgtatgcctctaattagtggaaaactggtagttttgggaatttgtttgttcatttacaagggagcagatgattgaaaagctcattaagcatcctaagcctcccatgctcagaccatattgcacacacaaaaaactcatattcggtgatatgatcaagagcgtttgtcagcatgtcaaaaactcaagctattagcataggtgttattctgcaccaaacactgaccattacctatttgtataaacttctatagaaacaattatagaaaaaaaataccctaagccattatagaaaaaatactataaactaaaattaacttatgcttaaactaattctctcatattagcttctctaattttaacttatgaaaaagatcatttcattttttcttcttttagaaatgtttcagcatgtttatccaaacataccctaagtcattaatgaaccccagggagagtgaactctataacattacttccccttggcggcaagacaagatcaatggctacctccgactttaaatttaggcagaaactgcttaaaaccaaggaactggtgggacaactagcccatatcccaacaattttttgtgaactcataggaatcaaactcaagtattagagaacttaccataggttcaaccaactaagctagagactccttagtaatcccaacaatattattcaatgttgtactgcaaacaatattagtaatcccacttgtaaaccccgaatctgatggcataaatcacacctctcatgaaactaattacagagcatcaaaggtttaaccattcaagtaaaaaaaaaattaaaaaaaaaaaaaacttgttgactcttcccgtattagcttcgatgtttagttaattatatttgaagcagtttctggactagtccaattaaacccaatatagtgttcgaaaaggctaaagcagtaaaaataaagaaaaatggagcgtctaaaggagaaaataggggaagaaggaacctgaattggacgtggaaggcaaggtgggcaagagagggatttgcggcaggagcgaacggttttgaactggtgaacgtcgagtttcttgttgatgatgccgacctggaagtagatgctgttggagggaggcaaatcgaccttgatctcatcgacgttgaaccagatgaagaggcgctggacctgaatgcccttgaggttggtgatggagccatagctgagcttgccggagatcttggtctcgtagtaaactaagtaatcgaactgtatgtagcagggcttcgccaaaacgacgacgaattgcccgtcctcgtcgagcgtgtagtcggtgacggtgtccggtaacagaccgctcgggaggccgtacttggggagtatctcgtacacgctctccttcgccgccaccgccgtgcaaagcagagtgctgaggattgccatgagagcaaacgcctctgatgatcggtttgagggtgttgttgttgccatggctcaaatcgtagagacaacttattccggttaccgcttttgttacgattctctctcgctctgtgtctcctttggggaagaggctcggttttaattttaaacaccaacaaccaacaacctctatcaattgacttatttcaaagaatattttggttttatcacaaataaaaaatgttttcggttcttagtttaactctgatttgtatctttttagtctcttaaaaggaatttttttattcttagcatttatattttaatttttttatctctataatttatattttaattcttctttagtttaaaaatactttttttatttttataatttatattttaatttagttttaatccatataatttaaaaataatttttttaattttttattttatattttaattctcttttaatcctaagtaatattattaatcataattaattataaaaatattaacaaattattcgtaactaatttattacaagataatttataataaaaaaatagttgataatttataattaattatttttatatatattttttaaaaaaattaaaagataattaagataattaaaatacaaattataagaactaaaaaaatcatttttaaactataaaaactaaaaaaaattaaaacataatcgataaaaactaaaagaaatacttttcatattataggactaaaacatttcaactaaatggtgaaactataaccaataaaaattaaaaacttttttttttaccatgatgactttcaggtatgactgacaggtaatacaccaaatgattacaagattaatcctttagtatataggcaaacttaacttggtatcgttacaaaggaagatataagatttatagttacgatagaaagaaataagagaaaaattacatatttaattttttctattaaaaaaattaataattaacctttatttacaaaacatattactatctaaaaatgtagttaagagtttagttttaaagttatatgtatggaaaaaaatattatgagatatcaatttcttaaataaataccaataattcaaaagagtgagatgtgattgttttacaagattaatatatgattcttacttcaaagatatcatgcgtttatcccaaaaaaaaatgacacactagtattaagaataatgaatattgtaattttggttcaacattaatgttgtatatatgttgattgttaatggttaactaatgagtgttaatattgtgatgagatgaaaattaatatttgataattaaaaattatttaattaattaaaatgtaaaacataaaaaagataaacgtatataaaattgaaaattgaaagaaaaaaaaaagattatctaaaatatgaggacttgatcataatatgttttcattattttctaatctttgtggaattggttatgcgatggtatgtttgtgttttactgtcgatttttgtgcttaaaggcactaaatgtagatttaagactcagtggaactctaagattgaagaaaaaacgtgtccaaaaggcttgatgttagtcactgcggttagcagctgcatgcttatgcatgttatcaattgttcgtgtctgtgataagctgtgttccaacagattgtgccttgacaactgtggtttcgactatgagcaaactggtcacgattgtgatcgagcgactttgaccccgatatgtcatcgttttacacttttaattgtattttgagttggaacccttttatagctcattgtttttatttgtgttctgaacttaagattagtgttttcagaagggtgattagtagatgacacatattgtgagagtgggagattatattattctttgactcttttaaaggtatgttgtttatttttttgctgtttattttgttttcatgactacaactgagtaatcatcgtgttctaggttaggagtttacaccatgacttcttattttaagattactgcctatatagtgttagtgtaaaacaaattacaatgtcgatcaataaaaaatcaacattaatgtacttttttaaagtagttttttttataaagttcagtaaattgatcatatattatgatttatgatggaataataataataataactataataaaataattatatagtgatataaaattatattttatcattagcatatcatttatttttcttaaatttaatctaatatatttttacataattacatgtgtcaatcaagaaaatttatcttaattgattaattaatatatatgaattattataaaattaaagataaatattaaaaaaattataataatttacatatgttattcagcttagattttcttagtaagtcttgttaattgaattactgatataataatttctaaataaaataaaatattatatcgattagcaccttggtagttggtagaaatccaaatatacgagttttttgttttggtgatttgcaattttttttccggagcttgctaggtatttttagtataacaaatcatatttcatctttatataataaagtttctcttcaagaattttttataacatccaaactcgtgggtcgcctcttataaaaaaaaacaactcgtgggacgcgtggccgtaccaacaatgcaaaactcaggacaacagctttcaagtttcaaatgtgacttttttctttttgagttttgcatacaataaagttatatttacgcaaacaataagcattttttttaaataaagtttgttaagtgcgagttttaatttatttatttatttaaggtaaaataaataaatatttttttaaaaataaaaatatttactaatcatgatatcttgttactatattattggatgttcatgatttaatctaatatccagatcgagtataaaagtaatatatcatttgattttattcaatttaaatattttattattatattataaaaaaatttacatcaggggtgctcatgagtaagcgtaacccaaattgatttcaatagtttggttgagtcatttgtatgttttatcaaaatcaaattgaactaactaatccaaattgttcacatatgatttgggtcatcgatttacatttataaatccgatcaataccgataaaaaaatggaaaattgtttggtttttttagatgttggaactaataaaagtgttaggacagctagtgttggaactccttgtattacttttaattatttgtttcacatttattgtcttattacaagaaattagtttgtaagaaacgattgtgatttagactattataataaatctagtgaaagaatattttgttttaattcgtattaatctattttataatattatattgatgatattaaataaattaattttattatttttcatttatttgattatattttgttaattgtattagatatttggttgaatcataatataaaattgtagttttaagaaaaaaaatatcaaattaaaatgggtaacccattggcatgaacttaaccaaatcaaattgtttatgaataggttgaattaggttgagttaaaaaaaattataaaaattgacccgaaacaaatctatcaaatttgattagattgaatcctgaatttgaccaaactcaatccgacccgcgaatacccctatttcacatactacaattattattttttatggaacatactaccattactatagtttttattttaagagataatattactaaagttggatatacagatacaaggcttgttgttaaacttacaacttgcaaaacttaaagttgtgatgcttattagcccattgttggcttatgtatgttataatatttttttttactcataaatataaaaatttaaaatttatttttagattatttttttatctattttttgttctcataaaattaatttttttttcaaagacataggttcagataatttaaacttacatccaaacctacatatacgcacgttgaaggaggtgatacaggtgacaacatgacaaaacgcataggagattggatatggtggttgcctgattggtggcatgacgagcagggctatggtggtgatggcttgtgatcaggccgtgtacagacattttggggcctaaggcgaaaatgtttaatgagtctttttttttacaagaattttaaagagacttagtatattatataaaatatcaatttttatattaatcttctagcttttttagctgcaagatcatttatcaaagttttataatcaagcaattctaacacttcactttcaatagataaaatagctaattcattcaatctatcttgtaacattgttgattttagatatgatttaaacaattttaattttgaaaaacttctctcagcagtagcaattgttacagggattgtcaataaaattatatatgcaatgtaaacatttggaaaaaaatctaaagttttaatataactcaatacttctattgatgtgctaatttcttttcttaaaacttctcttagtactttcaattttgaaaataaatcaagatcatcaatatcagagtattcattaaaccttaaaaactttttaagattaatacaatattttttcaattcatcctcatctaaagctttaatttttttggaatcaaataaaaaacaaaaaatagtctcatattataaaaattgttcaaatcgtgtctcaatagaattaattgattgatttaatatgtataaaaaatactcaatacgaaaagattcttcacgtgaatgtgtgatctcattactaatatttttatcaaaatgaggttttctatgaattttacatttttcacaaaattttggcgaagaaaaagtttgatcaatagacaataggttttattcaagggaaggagaagaatagattttttttataagagatgaaaaaacgtgaagaatgaagtttagagagtgagatacgttagttagttagttagttagttagttagttagttaggaaattgagatggattaaaggaaacttaatagggatttatttttttgggatgaataaaatactttaaatgatattaattgtgatattggttaattttttttaaaaaaatattaattgactaatttttaggaaaaagagagattctaaactattttattttgatcagttaaaatttgttaatagttaataataaaaaaaatttaaagacttaattttttttttggaccctaatttaccttataacttgccagaccctacttgtgatggtgagggagtgttgcttcttgcttgggtgtgggttgatgacctcacggtgacaaaggaggatgtctgggacaagggaggtggctgcgtttatttctcagtttgtttgggctatgatttaatgggactaaaaatttgtgagaattattaacctctaaaaattattttttagaattcaaattaaaaattataagttcagatttatttgaattattatatcattttacaaagataaattttaaacatttttatatttatatttatatttataattataatgataagaaaaatatattttagtttttattttactagcttaatgtgttttttctatagattttttttatattatttatttattaattaggtgtatgactatgaaatatatgttccaacagcaacttatagtatatgatcctgatccaatccttgacagctaggaagcgtctgagtccgagggaagacatgttcccacaaaccctaatattgttctcagcactcataatcctcttccatggagatctcgtcttaagcacaacagcaccagatgatatccacgatgttctccctcagtacggtttcccaaagggtcttcttcccaacaacgcggtctcctacaccctctcccccgacgatggcttcttcaccgtccagctcgatgccccctgctacgtccactgggacgaccaattagtctactaccacagccaaatcagtggcactctcacctacggttccgtctcgcacgtgtcggggattcaggcccagaaactcttcctctggctccctgttaccggaattaaggtccaccaggattccggcatgttagagttcttcgttggagctttgtcccagacgctacccgccagcgacttccaggatgtgcctgggtgctcccgcagaggatcgctgctcgctacaaacctcattcttcctctctgaccgtattcatctctgtctattctctcctactcatcttgttcaacttcaaattaattgtttcatactcaaatactacctactagcctactaccatgttaatgttaattaaaattatagggattttcagaagcgcgtcccctgtttcgcattcagggaattaatcccgttaatgtttgtttacattttttggactttaataaatttacttttttttaattagagggctctttttttttttctttaaaaattaagtatgaagtgattttatttaatggaatgttcctgcattaatcgcaagaaaaccaattataactatattttcttttcttaattctttttttagtagacaggtaaagattaacccctttttaatcgtagaaattatgaaagtgattttttatatttttggtactcataggcaatttaaaaacttatttttagcaattagatagctgagcaacttttccggtttcgtaagtaattatagttgaagtttctttgcgccaataccaatatgactatgattgatgattacattgatcgacaaaatcacacgcaaacgtgaaagcaacaattatccacatccaataacaaaacagcgtgaaagcaacaattatcagcttctgtcaggacgtgatttttcacggcaaatgtccctttaaaatcgcttgccaacatgctgtaatattaaattaacaggtgccacttgctaacctaagttttcttcttttaacaccaagacaaacataaaacattcgcttcaagtctctccactttctctggcttatggttatggccatgctaaacacatgacatgctgagattataagtataaatagtgatatttcaggatccaagaagcaattctacagaaaattctctgtttcagcttagagttttactcttccttctctaatggatcgtggaaatgaatgacttcactggcagtgggcaccaacaagaggagcagcattgcagcaatgaaagttcagataggaataagttattgatgaacaaacaaatagttttgatcttttggagaataagaaaaaaatacttcaacaaaatttctgatgcattcatcaatcaataacttccacaaacaacttaggattgagggagagaattcgttcacacgttttcaggatatgataaacaggcgcatgaatgattagagctgaatggaattgctgcattggctaaatagtactgcgtttgttacttcacacgcacacataaaaaaaaagtgtgattatttctttgttaaaatttatctaaaagcattcaataaattaaattaaacaatcatttttcttaatatagcagcaatcttagtatagaattgaagttaaaaaaagtcccttaataagggaaaatacaattgcacaacaaataattctctaaccaatcaaattttatggcacacttgtacgtaagtctgaactggttttccaagacatgcttgcttctagataactttttgtcctgaatcaaaccttttattttatacatcttgaaggcatcttctattctgacattatgcttagaccagatgcaagtgatggaatactttgttcatatctgaaaaaattgcttggatcaaccttggtctttacctctaccagtctatcatagtttcttttgaaatacttctcaccccagactctagcctctgcataactagcatttccaggtccattgacacctatatcaacgtctctatagttgatatatgaacttctaggtgaacttgacacataaggtgtcatataatcatagagcctccgaatccgatctagatatctgttagcaacatcttcaccctcctctttccaagtcacagagtattgaattttataaatgttaccagctctatgtggaaacggtgtttccacctcagaaatctcacccattttcccaccatagggattcaatgcaagagcaggtttttctagctccatcatcttgttccatataccttcaaggccagttttggaaattggttgctgcacataatctgatttcttcttcaagtatttctcctgtgtattatgcctttgaagcaaaacatcaaccgaagtccccactggatagttgtcccaaaacaacaccgaatcgatccaactcatttcaatgcactgttcagcaaccaaaccaagttcagggaagctcttattcatcacaccaagcaactcttgtgaatttccaaggaacaaggcattgaacttggctcttattgtcttcacaccctttcttttgacagaactaagaaccactctaataaacaagccatcatgtaacttatcagcaacatactgccacttatgaacaacatcagtggcaccttgttccaatgttctttcaactctgaaaacagttacaacctcaggaacaggaactaacctaattttccacgacacaacgactccaaagctagctcccccacctcctctaatagcccagaaaagatcttcccccattaacttcctatccaagactctaccttgagcatccacaattattgcatccaaaacatgatccacagagagaccaaacattctcatcatgttcccatagcctcctccactgaaatgtcctccaacaccaacactgtgacacaccccagctgggaaagcatggatcttgctcctctcagcgatcgcatgatagagttcaccaatcgttgaccccgagtcaacccacgcagtgtcatcatcatcatccaagttgactttgactgatctgagcataaacatgtcaagaataacaaatggggcttctgaaacgtaggagaggccatcgtagtcgtggcccccacttctgattctgatctcaaggttgaagcttttgcagcagatgatggaggcctggatgtgggacacgtgggttggtgccactatgaaggatggttttggagttgtggaggaactgaatctgaggtttctgatgtaggagtctaagatgggagggtatgaggggctgttggggaaataggtgacagcagagattggatttggaagagaggggtcagaatagagagagaggcactggagaatactgtcttgaaaaggttctgattctgaagcagccattagaacgtggagtagaaagggtaagatcgcaatcgcagacatctataggcatggacggattcaaatttcagaggttgcttgattcagttgtccatagatagatcttcttccgggttacgcgtgaaggataacatggaggaaacactagagataaaaagtaagcaatatctcaagctagggtccttttcctacggtgaaaagaaattaaaaaaaaaagaggttaaaaattttgaattaacataaaatataaaaatatcaatctcgttttattttactgttttttttttttttctcttttgctctctttctccgcagataaacattctaaattattcttaagggaaaaaaaggatagaaaaaaaagcacgtgcaagagagattatgcaatattattaatcaactaattaaattaccgagtgatggacggagactttagtttcttataggaaaaaaagagttatatgtataataaatttgtcaaatttttataaaaattatttaaacggtgatatgtgattaaatagcatgctaaaactaaaactaatgtatagttaataaacttctttctattctttttttcaaatatttttaatttttttggctgtattccatgtattatagatgagtaagttataaggatttgaattataattaagtcattctatttttctaagaagaatggcttacatgatcatccatgattggtcaaaaagctccgaacacgttacttacagtcttacaccataatcttcacttcgtctttgttccacttctacatattttcagtgcaacttccctcttcaacttttacgtaaaaccttttctaactaccatcttgtaatctactatctacttatattattattcggaaaataaacttacatatctataaaatggctctccaatctccagtagtgtcttttaaatatgtgcttgatatggtgtccttattattgtaattataaagaaagtaaattttgttattcgaaagactctaatggcatgcctggctatattcttaatactatatgatatactaattttgaaaacatacatataaagtataaataagaaggatatagagaaaggaataaaaaggaagcagaaagggctcccttccataaatgaacctcttttctatgttgcttcactgttggaacttcgaagtttctaacttgcatggaaattgaaggaaggtttgtccttggtccatgtcatttagcccctagaaaacatttcttgaacatcaaattggatacaaaaaagttgtattctttgatttcaaggtataatttttatatgcatgaataaaataagtaaaaaaaaaaaaaagataatcgtatgatacataacatatgctgtaaagctatgttcaaacaatggaaccttaaagttttagaagtaggcaattatgtattattatctaatacatatcttgaccaagggtcaattctggccacctgtttaaacacgtcaaaagtctaactaaacaacaaattacacgtttagttttaagaaaactaccaattagcatgattaacaatgttcccattgaagtatttcttatttgaaatcaggtttacctgaattaacaatagctcaaaatgtatgatgcctctccaagtggactaatattaaataggtgtcactcacaaagccaaagttctcttttcacgtgaagacaatcataaagacattctcttcaaggctctccactttctatgttttttctctggcttatggccatgctatacacatgctaggattataagtataaatagtgatctttcaggaacaaagaagccattctacagcaaaatcgctctctctctctctttcagcttagagttttaccttatcttctataatggatcatggaaagcacttcagtggcagtggcagtggaatcaacaagaatgaaagtaaagataggaagaagttattgatgagcagacaaatagttttggggaatgagaaagaagacatcaacaaaatggctgatgcgttcatcaacaacttccgcaaacagttgaagattgagagagaaaattcgttcaaacgttttcaggatatgatacacggaggcgcatgaatgacttgagctgaatggaattgctgcagtggctaaataatagtatgattgttacttcacacaagcaaaaaaaatgaagtgcgattatttcttaaaatggagattcaatagtgaaggatataattttggatttatgaaaattcttcagtagttcaaaaagttcacagtttctctaaatatttgtgttcctctcaatgccaccaaacattcagggaaaagactagttgtgcatatgccttttatttttcttaatttactttttataaatttgtctcacaagtaaagaagtaagtttgctcaaattatagttaaacactaattgcatacgtctctcccaacaagaatctcgaactatagtttcaatttcgtaggactcctagacttgattcacgctggtattagaaaactgtatttgacactacggcttttggaaaaatcttatccaagcatagcttacacttcaaaaacaagcaactgcttttcaaaccatacattggaatgacttttgccataacatgggatctgataggctcttccccctgcttactaaataaatcaacttgaccaaagatacaaaagtttttttgatgttttctaataaatcatatacaccggaaatgcatgtcttacaaacctaatatactgtaaagaaaggaaaaggcacagccttagagtgaaacaacatttacaatatctgccccctattcataattgtaaaggaatgacctcattctatagccaaaatcatacaattaacctcttctttacaatgaagcacaatctctttcccacacaggaaagtggataaacctgtttcaatttgattttcccaaaataccaacaatttccctaactgtataaccaagattatcatcagaggagtttggatctcaggcttgaagaacctgacagtgaacaatatgactcttcaaactaccacgtcccgctatagttgaccataaatttctaactaaagacctgacatgacctttcccagcaatattttcccaaagttgaggattgctctccacgcgtctgtttggactcgaaacatcaactagactgatgctcatattgttgcgtataatgcaaagctttccattaaggggaacaagagcagcagcgtcaagagcacgggatctacctaaatggagtttgctatcaatgaacttcttccatgaatctgatgctctgtcatatactttgagcttgcacccatcctggcaatcaagtgcatagagttgtccgttcagcgagatactaggattacgccaaccattgaccattccattactcactggggtccaggtatcagtttcctgggaataggattcacatatgacatttcgattagatccaagtcctttcaaaaaccatgttccgttatgaacaacaccaataaagggcaccattgctgtggtcatctctgagataaaactccacctgttccggttggggtcataaacttcagcagatcgaagagttctttgaattccttcacactccccaccagcaacatagagacagttatttattacacaagaaccaaacagatgacgtttccgcagcatatctggtgctctatgccacttattagtacgggcattgtagaaaataacacgtctcatagatcccttcagtggatctcttccaccaaataagtacaggtggcaaccactgagaaccgcacagccaaatcccaatgcttcagaatattccccaggaacaggaggaagggattgccacagttggtagatgggatcaaaagcatgcaatgaaattcttccatcacggtctcttttgatgacataaacccattcttctgccattccaagacttctcctgagtgaatagaagaaatttccagataggaggtgataccatctcttgcaaaccaaacgcagtttaccatgctcaacccgaggtacacgaatcaaacatgcaatagcaagatcatccggaagaccaggcaagagaggaggctgaactctggtcctctctctacgtgagtttttgctcctatgtgcatttgggtttatgtcaggttggatacataacttcgatcctggaacaaatttccttgccccaacaactgttttcaggcctgaatctactttacagtagcaagaaacagagtcaacctgtgaaattctccatgttagtatgttgaaagtatcatcaaaatatcaaaaagatttcatcaaaaatatgtatatgcataatgtccaagagcatattcacatgcacacagtaagcttttgatatttctccttccaactccaggttccaaagaattgaacagttcctactttctagtttcttctataccgctttttttcagcaagaaaacaataaaaggaagttccagaccaataacttcacaatctattgacttgtaaaacaataaattattatttattttattgatatgaaatttttattttcttagaaacgtcatattaagttttaaaattataatatatgaatgtagccatggaattttcaatgctgcaggtggggcagtaagatcttaagaccaagcaaaaggttatattagataggttcattacgtacttcctgatgaaaatattgaacaaatgccataacacttcagctatcctcagcttctgccaaaatatttctattcaaacccttgggtctaatatcctcaaattttaaaaaataagaaggaatagatatgcaatattttggaattaaaatacatccaaatgatgctcagagaaacatgaaaacagaaaacaagatcaagtaaatcacttgatttctgtctgtgaggcttaaataaaggtgttaggcgtaccattatcatccacataaaatacaaataaaatacaaaaaagagaattttcaagagaaaacaaggagcatctgggtatcatcagagagatatctaacaagagattgaaagtaaatttataaaaagttacatttaaaataatcccaagttaaaaaaatgaaattggtgaaaaattcccctttggctacataagaaaggccttttcagtaactacatcctgcatttgtaatacatatcatgtaagttacacttcagaatgagggaaggcagtgagtgagaatcagtaaatttgaaggatcataaaaggatgtgagaaggtgggatgattcgttaaacaaggttgacggagatactaccctccgctgaatttttaaattcagacaaaaaaaaatgaatattaggtatgagccatgaggaccattgttttagtttagatacatagtacaaatattaattagatcatacagagcagagatgagtgaactacaataaaggagaaatatagaaaagattgggaaacttatgaggagggaaagtagataagaagaactctatacaagagttatgataactgatcattttcaaaacccattattataagacaaatagcttaaggtagagctaatgatattgatgagcagaagaatttgcaggaatagtatgctcagggaaaagtttggcatataaaccaagatgaatttagtttgtcttatacatatacatataaaacctgatagctttcaatggaaaatcatggggaacaaagtaaaaggaaaaatgaaaaaataaatccctatgctatttgaaggtgacaaataaaaaaccaagctcactcttgatcaaatagctaaatgaaaacgaagaacaaaggctggatattaatgagcattgcagctatgtactaagattacacttctaaatttacagcagctggaaaattctaataaaattattcctgaaaaaattattatggcaagaaatggaagtagatagaagaatgatgagaatctagctagccaagaaaacaaaaacaacaggggaacattagcccaaaacagctctccactttctcagcacatccatcagagaaattaactctagagagaagtattccacccccctctctcctaattaaaaatgagggaatgactcctaatttcccttgttggtaacattctctgtcaaaggtgtggagtatggaagttaacattccacatatgtaaaacacaagctaagtacaacttgtaattagcaagaccaaattgcatcaacaaaaatgttttggattcattcctgctgatgaattagtgatatgcaatcttggattggagcaaccccccaaacccttaacaatttagccttttaggtgccaaaaaacaaagagaacgaacggtagcattctcagtcaaaggtgaggagtatggacgatacataaatgttagttgcgaacaactctctagtctagtctagtacatcatgtttaggttggattagtatttaggaaagtcaacacacaatgcatgttgaggcagcaagagacttctaagatctaattttgacttggtcagaaataagagccctagaaataaaaagagagcttcttcccatttaagaactctaaggttcacagactacccaattgactcaagttacaacttacaatctcaacttagttttttgcctctctaccaaacacaagcagaaaatggtaggaactcgagttggcaaatcgaaccttttatcaacacacacacaaaaagctgcaactaagaaatggagaaaaagttatacgattcaaaagagagaaaaaaaactattatgctgataaaaaaattggagtgaattggacttaccagtggagcttgaactctagagaccctttgagtattcattgagctttcaactaactggttcatctccgaagctaagtctcgcaaatgaatggatttttcaacgcaaattaagcatcttggtgcagatcaacacaaccccttttgaacctacccttgaattcctggaacccgatccagtgagcagaagagcaaagcttgtatctttacctcaggacctgcaagagaacgaaaaacaaggaaatgggtcattcgagttttgaaggaagaagaactaaagagcggtgagatgaggagcaccttctcttctctcactctcttctttctttcacctttggttgagagaatgagaaagaaaccacaagctttagcttcacagaaattgtgtgattttttttttctctcttggggatttgggaaaaattaattaaagtggtttttatttttattttaataactgagttgtgtgaatttgcgaaattttaatataaattgtataactgtcctaagaggacacatcgcttgtggcgatggtcctctttaataaatgtgttgcagttcatgggtcaaaccaacccaactttgaaggcaaaggagagagagagagaggtcaagggttttcttttttccgatttgttgatcgcagaaaatatcatccttttgtgggattgtgaagattggtcatcacatggctccttcgaacagcttttttgtctttttctttaacacattttccttttctttaacccacggccagtttggtgtttgcattgtttgcgagttccgatggttgcattatttttttttctctctatgtatctacttatttttcattaatatttaaagaaaaaataattaagtaagtatatattaaaaaaataattaataatctaaaaattagaaaaatatcttataaaagagataaaaaaatttaaaaagtaatcttatagttatagttaaggacggagaaaatatcaattaaaattaagcttttaacatatatactgtgtttttgaaatattaaataaaaatatgaaaaattatagatctaataaatacatcattataaacaaaacaataaaagtattctctttgtcactagttataagagtcttttaattaattcacgccccttaaaaataataattataacattaaatatgttaattatttgtacaattatttcaaaattacctttttattctctttctatatctatttacttatttctcatcaatgttttaagaaagaataattaagtatgaatatgtaagaaaaaaataattaacgcatttaaaaattagaaaaagatcttataaaaagtaacaaacaatttttttaaaaaggaaaaaaaatatctaagtttatctgaatttagaattttaattaaagtttactattaagtgtatagattaattaacatgcaacttaatgaattatctcaactttaaattttgaatataaatttatgttattaaacactcattaagaaattttacctctcatcatgatcttactcaattctaacaacactatcttctgtaaaaagttttaagtttggttaatttagttttgaaaaataggataaatctaagaactgaactaataaagatatttagtttattcagttcaagttagacccaattgcataagaattcgagccaatgtaactaattacacacatataataaaaaaggttgttttaattctggttaattcagtttcaaaaaatataagtctaagaattgaactaatttaatccattcagctccagttggacccagccgtgtaaaaaagagacaattttatatattcggactgagtcgttaggctgacaaaatttaatgaacactcctaattgagggggatttgaatttaaattatcacttcaaaaggttacaacataagtagtaaatatcatggtagcttcccccaaagtgattcttgttatccctattcaatgtttataaaaatttaaaaaatgatattttgatcagtgtgttgcataggatatatatttatgtgtatataattatagttaaaatttataataaataaatattttgaatttacaataaataatttaagttatggtataagtttatttataaatttaaattgatatatggttgagaaaatcaaatatacaaataaagattaaaaaaattgtaaagtgcaccgcgtaagaaaaaatgaaagggatcgtggaaaatatttgagaaagtgaaaaaagtgagtgtaacactctccgaactagggattgtaatttataatgagtataaatatatgttatcataaaattacttggattaagagatgtatattgaaattgggatagaatttcatgtgaacttttcttttccacacgtctaaggttcaataaggaagacaagccctgccttagtagacttactgacttagattagaatagaactttctacttatgaagaattattgactattataggtctcctatagtaatcacatccacaagtctataaataagggtcccgttctatacgtaatttttctccactcaagtacctttctattttaatcggaattattggcttgatcatcaattttgggatacatggtcggtccacttctttaacaacctcaagctatctagaatagacaagacaaaactaatccgactttataataaatgtagcctttgaaatacaaataaatagttggccgaacacctaaaatgaattcataatgtcaaactggagggaaaagaacctctattatttgtttttgtttgtatatagaaaaatattacaccgagggtgaatgatcaaacttggaaaccattcggagcaaaggttctttagttagaaatatcaaaagcaaaatctcgcgaagaatacataaaattaccacagatacactcagagaacataaggaactgtgctactattagtgactacattaggtgtggtgggatacacacaaaaataaagacaggcatattcctttctaaactcgtataattaagaaaaaaagggaaagtatgagtgaaaacattatttgataataatgtggcacacgccctgttgtgcaacgtaataagataacctttgcccttggtctatgttaatctctcactaaatatatagaattcaaacataatgaacatgtttccatactagtcacaaggcataaaaagtctgctcaattgaaatcatcggcgggaaccttttgttcatttcagccaccactataatattacaaaaacctttgcccaacaaagtggggaaatattaaatttcaacataaattggttgaaactggaaagagcatgctttgagagagaagtcagaaaaccatgatcggctataacaaaaagctcgatttctccccttgcacaatctacaaccagtcccaccaaaattatcacccaaaatgaagggtataaaaagttgtcgataagaaactcctaatatgttagtaatcaccaatacctaccatcattacacaacctttattgatgtggctactagaccacatacacaaacccattccccacaatgattagcactgtaaaatagtacaaaatgatgtggcttgaaacacaagtaaattgaagatcataaaaacccgaggggagaaaaatcatcctgtaggcgtatccacacctatacctaagatggtatgtaatgctatgaaaagaagaaagtcaatcccaagcactagtgaccccaggaccataccctccaccagcatacccaccagagcctccatatccaccaccactgctgtttcccgcactgtagtaatcagaagaacctctactgaaagagccctctcttcgaaagtcacgactaccaaatcgaccgcctgatcgccggttcctgcctccaccaaaagaagatcgagcagcataccgtgagagccaagcaggtacttcttgatttgcttcttgcatcagttctgataaagctctagctagcgatgaattgttatcattaaagaatgcagttgcaagacctttctttccagctcgccctgttcttccaattcggtgtacataatcatcaatgtcatttggcaggtcaaagttgaccacatgagcaacatggggaatatcaagaccacgtgcagcaacatcggtggcaaccaatatgggggtgttgccacttttaaatgacctcaaggctaattctctttcctgcgggtatttcagaattgatgagcacagtaagacaaacaagtatatccataaccaataatattggtgcagttcaaaaccagcaaaaaaattagtaaatgctatgaagtaaaagggtttaatatgagggtagcaagttcaatagcaatttcttaacactaaactaccaagcaaaaatgatgcaagaatccaggaccatgaccctattaatgaaaaaacctgggaaaaataaataatatataagaatatatgtaagctccaggtccaaacaaacaaaccaataataagttaataacatcagagaatgaccgcaaaagatgtgcccaaaaaaaggatgcagaagaaaacagtcattttaaacctaataatattgcctgtaaccaaaaacaattcttttttagaaataaccacttgatagcggttctagacttctagtcctgaaatgtttgacttgcaaatcttgcaaggctcaagattctgtgttttgtattagagtggtaggaatgaagtaaacagaaaattggaattcaataaaattgcagcagaacaataacaaaatagtttcttccattaatgcaatggtgtttcaagtcatctctaaataaaacccaaataaaatgctcaatccaactttattagctatagaaacttcttgtcctctgttcaggtaaaagtaacttcacattctaatcttctttttgttctgatttctctcattttctcttgcttctctgttaatatagttttccttctccactattatgctaagggcgttttttattctgttgcttaaaaatttaaggattggttgctaaaataaataattactttaaagacactttttctccctcaattttaagcaactgacgcttaaatgaggtaggagccacttaagaacatacaatggagagcacaaatacaaatgctctataagaggcacaaaacatgctcttttcttggcataatataaccactgttcatccgttacattttaatgagaattttgtttttgtcagatatattagctctttttttaagtgagagattacaaatcttaatttgtgcagaatttgttaaaccaaaggtaacggtttgagagatggcagttgtgagagtgaaaagaattattaaaaaaaagagtccatactcattcagggaatatgcaattcatttcaaatggcaaagaactgtgactacaaactacagtcaacggcaatccaggaaagtaaaatgttgcatcggtttgagagattgtgagagtaaaaagaattattaaacaaagagttcatactcattcagggaacatgcgattcatttcaaatggcaaagaattgtgactacaaacaaaaagtcaatggcaatatgggaaagagatatgtggtcaaaaagggggaatttgggagtctataaaatgtttcatatttttaatttaattattaacaataatacacacaatttttcacatagcactatagcactcttatgttatacgtcaatcatcatagacatatgacaacccattacaacaagtgctgtttactattaaacatttgtgcaatagactaacctgctgtgacctgtcaccatgaatagtagttgctggaaaaccattaagacacaaccaatgttccagcgaatcagctcccttcttagtctccacaaaaactaaagttaaagcttgctgaaaaaaaaaatatacgcatgaaataattaaaactaaatcagctcccttcttagtctccacaatatgagagaataaaatacattatctacactataaatcccccatacaaactgaaattccaatgtaactatgcaaaggcattacctgacagagttcaaaataattaaaacaccataatccacacattgacctaaaatgtcaatacaaacaagtgcatgcatgttgctcagaatcagtttagactgtcctgtagatatttctttacaaaaactatgattggcaatttttgagagagctgggtattccctaaagtccttggacaagttttcttactactacctttgttggttttggtagagggtaaagaagctaaattttttgccaataagccatctatgctacactttgaggtagactgtcaaagcgtaattctcgtatctataaggagaattcaatggatgagcaaattcttgacgttcatttagtctctaatatcacttgtaataagttttatgtaagtgaagtacctttccttgtacaccatttgccctctgtgcatgaagaaggtccattaggtgacttctcttgtcagactcttgaacatactcaactctttggacaattaaatcagtacttgaacccactcttccaacagcaaggaaaatataatttgaaaggaaatcagaagccaatctctgcatatcaaccagaaatcataagaggtctgaaaagttataatatacacaacaattaggtattcatgcattgtttgtttatacctctcaaggcacttatcatctcaaataaaattaaaaacaaccaaattacattattctaaaggcactctttctgaaatagaagaggagggagattaacagcaagaccccttagatacaagtatgtgattcacagatacacaaagaaaatgcatatcagagcaatgaaaacctatgctataaagtaaaacacatctccctaagtgcatagacttccaaccagcactaaaaggagtccaaaatatatgcagaccctagacaatggggcaacaaaggaggggggaagcaaaccaaactgcaccatgaaataggaaaaatagcaaaattaagaaacacattcttaactaaaatcatatgccagatgaaagcatattttacagactatatcaaacctgtatctcttttggaaatgttgcactgaacaacatagtctgtctggcacctggtggaggcatgtccatttgctctacaatcttccttatttgtggctcaaaacccatatccagcatccgatctgcctcatctaatgccagatatcgaatcatctgcagtgaaactctagctctctccagcaaatctaccagtcttccaggagttgcaacaagaatgtccacccctctttcaagatcccgcagctagagaaaatataagttgttagggtaagggtatataccaaaacctaaaagttcttactgatcatttaaagaaatttgatgggtcaatctagattccatattcgacccattaagtaaaatttgcaacaggatagaatctacaagagaatgaatctacagtgataagtttgagactcattaattacaaggtgcagcacctccagcaaatgtactacaatataatatataaccacaaagttcttgaccaaccaatacccacacagaaatgcaaaacttctcaagtacagaattgcagcattatcggaagattgaaatcatgaaaatccaaacactactgaagctcgaaaaggatgtaacaaaatttcacaccatggctcattatgaaaccatgagactatgtatgcttccaaacatgtgcatacattatttttttttctccactcggactacccacacaacacatgcttcacatatgctgtggtccctagtattttcatgctgcttgcattcatcattcaaggtgcggcggttccctacctcttattctggtatttaattgccgttgttatatctatattttgttgttttgccttgcacgttgactctgatgtgtgctctggctatgtgtgctgaaagagtgaaaaatgagtgcaacaaataaagaggttgttacctgaagccactgtgtaagtgtcccttgcatctccctgctttattttgactgtaatgtgttgaattgtttatagtttctttactttcaatgccaatatatatatatatgcttataatcttctgtcaaaatgcttctaaatctatgtattttatgactttgttaactatataaaacatttctaattattatcatgaatctgacaattaattatacagatcagaaaacgagtcttctgattcaaatccctatttgacaaccataattatcaaacttggatctcaaattgaactaactttgtttggtaatttgaaacaaggtgtgtacacgccagagagagaaagagctataaaattgaaacatctatcaagaatatcatgccatggactcataaaaagttgtgggagaaacaaagtaaaaagaaacaaagataaaaggaaaaaacctgctggtttattggtgctccaccatatgcaacaactaccctaaccccagtttggtatgaaaacttcctagcctcttcatgtatctgaaaccaaattacaacatttcaaatatattttcattgcagaacaacgtccaattaaaaccataccataaatacaaggttaatgtaactaactcacttgcattgataactccctcgttggagaaagaacaagcgcaagcggatacactgtacgcaccccacgaggtggcctctgcacaggttggcccctcatgattccactgataatcgggaagcagaatgcagctgtctttccagaaccagtctgcgcacaagccatcaaatcccgtccagctagagatatcggtatggcatgccgctgaacaggtgttggcttcacatatttgcaccttcttatattctgattaagtgcttcacccaaatcaatctctgcaaacgtattcacaggtgggggcacattgtcaccactggtctccactggaatgtcttcatatgcatcaaaatttattcctgtattctcctgctcactgaatgcctcttcagcgttatcctcttcttcaaagggattgacttcccgctccctgccacgatcccatccaccacttttgtttccccatccacctgtacgtccaccaccaccaccatacccaggacgataatcatttctgggtgcagcataacgggatccagaattaccagcaccagaactagagccagcaccagaagaagggccactatatgctggagcaggggcaggggattctgctgctggctgacggttcctcagatgaggaggtacataaacaggtcgcgtgggagctaaagtgctaccagttcccacattgtcagcagaagaaccaggacctgcattttcggctgcagaatttgcagccaaatcagcccatgaagttcgcatagtcaatcacaaattctcgtagtcaacagttgtccgcaaaattcaaagggaaaacccctcctttccagaatcaggatagcagctttacaagtagcctccaattaaaaaaataaaacaaaaaaactgctgaaacagataaatactcttcaaaacgaacaaaattgcttagaagcagccctgcaaagcaacgaattccgatcaataaccgttgcaaacatatttacatcacgatatcacataaagcagaagccgattagcagaacacatcaaacacaatcgacaaagtcacaaaaatgcaaaagcacaaacttaacaaacgagaagaacaaaacaatggatgagttaaaacgaagttcattctcctcgaaatctcaaatagaatatagcataagcaaaatggcgaaccaaacacaatgtctttgaaagacaaatacgaaaacaaccgaaacgagcaaaaaacaccatagccgaagcaacgaagaaagaatgatagtaatagtaataagggcacgcagattgcagatagatagagagagaagagcgatggatgcacctgagtcgtattgggaaggtaaaaccctaaaacggtgagagcagtgagaaatgaagaagatcgagaaaccctaatttttggtttggttgcagaaagagaaagagaggagaaggcgccttcaaaggttagaaacaacaaaatatcttttctctcttttgtaatgtttttcttcctcttctcaaaacttgaaattcaaaatagaataaatatatttaatttaaaaataaatggtatataaactcacattgtagaaaaaataaaatttaacattatccctttctttcaattatctattaacatataaatctatatatctataactatctatactaatataattactaataataaacgaaatatctcattttggtgttcatattttttaaacaattttaccctccttcagtttattctcttcttaacagatgtccctctgtaattttatcctttcttttcttacttttttttttatacttctgaacctttttttcttcttttccttttttatttataagacatgagagtcttttttctcctactctgtaactactaataataaactgataaagacaactaatatttttggtgtacgcatttcttattcttaaattacccttcaaaatatataattgttttcatttccttcataaatctctataactattaataaaaataattatccttttttatgtaaatatttcttatttctaaattatccttcaatatttataactactttcaattccttccttagaccttcaaaatgtaactattgttatcagtacattcttcaacttcttttttttttcttttcacttgaaaaatacagaggcacaaagtatctttttttcaactagtatatataaaggggttaagatattttttgtatccacatttatcttcatattttatcgttataattaccttttaaaatctttttggcttaattataaattttatcatcaaagtttttaatttttgtgtattttatcaccattgacgaaagatgaatgattttaactttttgatatcggttgtaattataattaatttagaaaagtaattttttgtaaaaatttagaaaagtaactttttacatcattttgttactaatgtgatgctaaactacacaaaaataaaaaatatgaatgataaaatttgcaaaatgtcaaaagtttgatggtaaaatttgtggggaaaaaaaaaacttgagtgataaaatctacaaaattacaaaagttgagtgataaaatttgcaaaaaaaaattacaaaataatgaaagtttggtaacaaaatttataataacccatatttgtttataagcacttaggaaaagtgtggcaggagtaattacactacatattaatccaaaatcttaaggcttttatgaatatttctttcacctatatagtgttcaacatacttatttctatatgatgtgggacctcacatcatacttctactcgaagaatatgtcttcgttggaagtgctacacagttataactttttctactctcttgacccatggataacatgtcctaaaatgatataaaagatcttcacaattcattgaatttgggacatattgattataggtttgagttagttgttactgttttgtttcgatttgaggcattgtatctttgttgtttttgtgtctatttttgttatgtgttaattctgatcttgtaatggctttagttgcttgagaagatttagtcccaacaaaattgagtgcgccctctcatggaaacgttaatgagatgcatgttataagttgttcatatctggaacataaaggacaaatcatttataaaatgaaggaattatgaataagagtaattcaaattcctcatccaaacacaaggtaaaggctttcagattaggcaatccataataggctagaaaggctaccggattacttagtctggaaaagcaagcacacttatgaatcacatgatccagaagtccaaaaataaagttaaaatttaaaagctctagacggggtatttttggaaacgggtaaattttaaaatctaagggggtgcaggaagcaacagtcgagtttgtcagttgggttttttggatcgggttgcgtgacccagtttggcccaaaagtgacttaatccaaatattttgccctaacacgattacacgagtcgttttctgattctcctacatcctcacaaagatgcaaaccgagcactcttctctcgtttctcagctgctcccttattgtgatttgtgagtgctctgtatctgtatctgtaactgtaccatactgttgctgataagaatataatatgatagaacttggtatctgactatctgctaagtttttggtactttgttctttagtcaacttagactttttggtaatgaatttgttatgctagtaaagtcctagaagctttctgtggcatcattttgtgaaatagaaaatttattttgctgcatcttagggggataaatttagagagatagacttgtagagaaatttttggaacaactctgatctcctggtttataatcacaagcatcaatttgcattcagtgtgaacattgcttttgttttgtttgttaaatttaaacccctttctaactttcatcagttcagaataatgttttgcccaaaattgttgttttcagttgataccctcccctccaatgtcttacatttttcgctgattttattttatttccaatttgtctttcctcagattatgttaagtcccaaataatgtcttctaagagagcctcatcagttacagttagttgtcttttgaagttgtgcaaaggatgttgctcacacaaaggccttagtacattgagtgctgttagtactgctgctgaaaggacagatttacagttttctggtggttatcaaaatgatgattcttcaggttaccagcaaaatcgtgttgggttttatctggaaagccaaaataaggctgattcttatgagcttttgaacaagcaaagacctgattatgtttcccaagcaaatgcagggcaaaattcttatggagctggtcagattgcagatggaggtcatataaatgtgacccgaaatgttcacaataatttggtgggtcacaatggaagtgtcaatgggtactttggtcaaggcgacatgaaaatgcaacaaaaagttggggcaggtgttgataatgcatggggctctgggatgcatgcaaatccatttgttgagaaacatgattggacacaggaacctggacaagggatgcagtctcccaatgcatatagttcacctgggcctttagagtcacagggaaatcttagaggggacctaaatcaaaacattgatcattttcagcagccacaaaatgttcattacaaagggagtcatgaaatgcgtccacagtacccaggttatggacagtctcagcagagtctaaaagatggtcaatatttgccaaatttgaatactgcacaaagatcagtggttggctctcatctatcaagtaatgcaaatcctgatggcgaatcagccaaagcatctaatgatagtccatatagaggtacacttgaggaattagataatttctgcattgagggtaacgtgaaggaagcagttgaagttttggaattgctggaaaaactagatattcctgtggatttgccccgatatttgcaattaatgcaccaatgtggggagaataagtctcttgaagaggcaaaaaatgtacacaggcatgctttacaacatctgtcacctctccaagtcagcacatataatagaattttggagatgtatttagaatgtggttctgtagatgatgctctcaacattttcaacaatatgccagagcgcaatttgactacttgggatactatgataacacagcttgctaagaatgggtttgccgaagattcaattgatctatttactcaattcaaaaacttgggactgaaacctgatgggcagatgttcattggagttctatttgcatgtggtatgctgggagatattgacgagggaatgcagcactttgaatccatgaacaaggattacggcattgtaccatctatgactcattttgtcagtgtagtagacatgattggcagcattgggcatctggatgaagcctttgagttcattgaaaagatgccaatgaagccaagtgctgatatatgggagactttgatgaatctctgtagagttcatgggaacactgggctgggggattgttgtgctgaactagttgagcagctagattcttcttgtttaaatgagcaatcaaaggctggtcttgtacctgtaaaagcctcagatttgacaaaagagaaagaaaaaaggactttgacaaacaaaaatcttcttgaagtaaggagtcgagtccgtgaatatcgagcaggagatacttttcatcctgaaagtgataagatatatgccctgcttagaggtttaaagtcacaaatgaaagaagctggctatgttccggagacaaaatttgtgttgcatgacatagatcaggaaggcaaagaagaagctcttcttgcccacagcgagagacttgctattgcttatggtctccttaacagccctgctcgcgctccgatgagggtaattaagaacctccgtgtttgtggtgattgccatacagcactgaagattatttctaagcttgtaggcagagaactcattattcgagatgcgaaaaggttccaccattttaacgatggactatgctcctgcagggattattggtgaacatgaacttaggtacttcctgcctcttaattttttatatttcccttgttatttgattggtagctaatgaatttattggaactgaaatgtctgcaatttgtgtgagcaaaattttatacttcagaagtagttaagctcaacttacatgaaacaaatcttccttatttgtttgttgttcaatatagtgtgcttagtttttagagtatgtaccatgtgcaaatacaatgagttttgccagtaaaactccagcctagaggtactttattgcaactatactttttctaagctgactaaattgttagtcataaggaaggctatgatttattaatacagaagagtgaaagacttaaaactgtcagtttgttaacattacaactcctaatgctttagtaaaagcagagagtgcatgacagatacatctccaattggtgcttaatatatccttattctaatgttgctttctaaaagagatgaaaatgggatttccattttcacttctaggagttgcaatttcatatttgggcttatgaatttatgatagaaaattgagcagaggccaatgtgaattggtttgaacaaatgtgaagtattgcgtcctgattctggatcctttcccttttttttctcttaagaatagggcagtgttatgatttaagagagaaatatactaatagtgtctatgtatgactggtggactgttgcatgggtgatggtctgtcccttaaccatacaattcctgtctctctcatataggacactctgtatcttggggaaaatgaaagaatataaatccttgaatcccttgtgcgaaacacttgtcaaagggactgttcaattggccataggacatggaataatcattcagcctcgtcctgacccatcatttgaattccgggcaaatgcttgataactccatattgttttacctggggtgaaacaaacctttctggtgtaatatacttacaaagtcttgtttgagggcattgaaagctttgtgcaatatttgcggcgttgagcatattatctgtttgccattttacaacatgaatatgatggtaatgtggatttctatgatgctttttttaaccttttatcttatttggcctttgatatttttgtcaattgtgtcatgaagcaaaattaaggtaagcctcacaacaatcttgttatgcagatgtatcctgattcctgactaccagatggattgaatagaatggctgttggtaagtaacccctcaagccagcagatagggaaattgttcatatatctcccggtcattaaattaaaattgatctttatatccacgaggagattggaattttgtttaaccaggctcttccacactaataaatcaagcagtgggacgtgcattcaggttgcagaggcattattcattgagtagttttatataattggttgttgtagcttccatataagatataaattattattgtcactccaggcaagggaaaagcttatgtagttaatagacaacattttttttgaaaggcagttcatagacaacattgacattcaatggtataatttcagacaacttttttggatgtcagaacctagtcatttaccacaatcttaaaatccaaatcatctgagttatagtctaaacttgtttgcctttcattctttcttgcctcttctgtgtcaaagttcttgctggtgttcataattggacgtttccttcttgcatatatgtgtgtgttggcagtttgagttttgatatggcttgccaagtgggagatagctgtcttgttgtttttggtgcgtagggaactagggatttgtaggtcaaaactagtacttgggtactagtctacttgctgattaaaaaaagggtacttatctactcctctttttggtgttgagcaagagattcagctccctgcggaagctttgttggagcatttaggatgcttcggtggtggggtgcccctttcgtaatagttaatgtttgtgataacgaattgaataggtaatggataagatgtactttaatgaggacattgacacaatcacgtgtgactgttgtcttagcaacatacaaactcgctttaggcatgggagcagggccaggaaattattttaggtccaatgaaaggcttatgctaggcttttcaagggagagggagacgggataacaagaaaatggaaaaacagtgaagcgcgtatcaagtgattgaattattgtattggcaattcatgtctcacaactcatactaagctttccaaaaatactgatataggagaagaaaaaaataaaattcatttcttcaaaagttaaaattaacttgtgcacaagttaattaatttgtaaaaacttttcgtattagttctttcaaaaactatcgtttacttgtgcataggctgatggtggtgcggaacacctgatggaaaccgattttgagatccaagttggaattggaagagatgacaattttttagtgctttttaaaaataaaatatagtgatgtttttcaatcattattattttaaaatttaaaattttgacaatattaacaaaacactaactttgttcacagaggaagcaaatatggttttaaaatttaatggatcaaaatgaaaaaattatgacatttagctttaaaaaaaacaaggtaaatattacgagttcacttttgacttttttttatatccccatcttatttaaataacttaaaaatagtaaaaaaatcctttttatttttacaaatatcttgtgtgtgacttaagttttcgatataaatttaaaaattcatttttcatttttaaaatataaattttagttacatgttttaagtgttctcggtgattattttccgttaaaataaaaattatttaataatatacttttatattataaattagaatataaactcaaagagaaaatttcttattagtttcactctcaattagatattttaatatttctttatgtgtttttcatatgctaactacataattagccaaaataattgtatctcaaatttcaactattttaagttatcctcgtgtcatctttccatgtatatttgatcttttgttgtccatttcaatttatctttcacaaaaaaaatactttattacaaaatttaatagtaaaataataactttatcataatttaaattacttattatacatctaaaatataatttacatatttaaaaatatttattaatataaattttaatttaaaaacaaaaaagtataaaaaacctgctcctaaagttacattttaaaacaactttacaattttggcttaatgacattttttacctttaattttttatttttttattttatcccaacaacaatttgacatattttacctcaaatttttaacaaatttagagattttatcctcattttttttacttttaatataatttcatttttttaaaaaaaattggccaattttgcatttagttttttatttttttgataaattttaccttcaatctttatgtttattaataaaaaatgactgacgataaaatttataatttttttaaaagttggaataaaatatacgaaattaaaaaattagaagtaaaatttatccaaaataaaaaaaatggaggttaaaaatgcaaaaggctacaatttttaaaatccaaagctcaacacatccacctagtcccaatatcgttgttgagcatgagtgttaattgttggtaatttcaattttgcccccgaaaaagaagtggttatcgaacaaaatgagcatagcgaagcctcctaaacgctttggtttcttcaccaccaccacccttctttctctctctctctttctaaaaaccagaaacaacaaacacaaaccgaaaaggcgaaaggggttttccgagtgagatctagggtttccatcgattcggagagaggatattgatcgaacgacctcagcgagcaaggacaggaggtggagtactagatcatggattcggtgccttcgaattcgcatggaaacctcgatgagcagatttctcagctcatgcagtgcaaacccttgtccgagcaagaggtaacgttgttcccgaaaccgcttcatctcgctccgttttattcctttcgttattaagaaatgcgatgcgcggatcgggaaaatctcttgttatttgtcatcggttttggctttttgctccaactgcttctcgcgcatcgatccgtggcttgttgtatcgaaaattgaatcagttcctcttttttgtgaaatctggtttctctcggaattggaatggcgactggagtgcgcgtttgttcgaatattccgttagatttgcggaattcgtggtagcgattctagttttcttttttttttttaaattattttacattgattctgagtatatcatgttattgtggttttttagttttagacctatttcaattggtcgcaattaattatgcttttctgcatttaaggcgtggatattttagattgttaacattgaccgaggattatttgaggaggaggaatatatttccttctctatgcttgagtgtggtgtgttggtaagggttttatgatgaattatatgatttgtacgttaattttttatacgataacttgttacctgccttatttgggagggcagtaagtactatggaatggatactccctgttaagtctgcaagttaggagctattgtttgctatggagtgttgtttatgagttatgagtctatgcttattgcttaaggaggggttagttttcttttttgtccctagttggttggcattggtttttgaagtaatttaggcagagttttcggtcttgagtcaggaatacagctctgacattacatacgttggatgatgtttgtcttattttggtacttacgaaaagcggttatttgcacgtgttaataattaataagtaataagtaagaatatggaaggagtcagcaaagctgaagggaaatattaaaaacttccggttccttgaatgcacttgttaataattaataagtaataagtaagaattccgtgctactttctcctactgcctatcttgtaaagcatctgtattcgtcaagttaaacatttccaattagtttcactttctttctgttatttgcacgtgtcatcgtatttgatcggtgggattcagggagttcaaagaaagttctacctaggtttttgtgggttcagatcaattttcctttttagcagagtaagttactagtggcaacctgcgctgcttttgtggtgatgtggggcagaggatcctatgaccactttaatgctgctgttttttgtttattgtttctcacagatcacagctgaggtagcggtctttcacagaaaaaatcacacctatagaattcacaacaatgaacaggataaatccttgttttttctctacccttctaattatggccattgattttttttattttagtttttatttattttacagtttaaactctttgctgaatcagagggatttatggttgaaaactttgaatctctacatccattaaaataaaaaaacccagcattcccaccctccgttcacaattcagtgttcttttgatgcgttttccaggtttctaactaacacttaaaagcccaaaccatagttgtcaatagtgtgtgattattgtgagacattgtgtcatggcccttggccgctacagaaaagaattagtcttctttctggaaatagccttgccattgagatagtgttgtgattctttttgatttagcaatccaactctgatttcactttgcacttgtgtgtacaggtaagggtcttgtgtgataaggcaaaagagattttgatggaagagagcaatgtacaggtgagtctgtgtgtattttttatcatttatgttagcctgtttatatttgtgcttttcagtgtaggatttttttaaattggttcatatttcaccaacattgtttgcatcaagccccttttccctctcaatttgtggcctttatctattaaggaggtcttattatccaccctttatattggtttttactttgtttaatatgtttatttgtagggctttaactcatgatgattttgaatgactgagaaaactaaagacattatttcatttgccaataattgcagcctgtgaaaagtcctgttacaatttgtggtgatattcatgggcaattccatgatcttgcagagctttttcgcattggagggaaggtattctttatgattgacgtttttacattcaacatgtattaattaaatttgtgacacgttgactacatagatttatatgtatgaaatatgtagtacttggaaaaccaggaaattccatgctccttagtgttgtattgtgaaattaggtttggcctacttcttatttcatagcagaaagtctaatttttaattgagaaacaaactgcagtgtttattgccaatcagttacatagtctctcattgtcttatttcaaatttgagaactaatgtgctatgtgcttattttattcttgattgaaaccattattttttagcatctcatccttgcatatttaaatatttttttgcttctagttgaaatatggaacctctttgttaaatactgattcttgttacctttttttgttggtagtgtccagatacaaattacttgtttatgggagattatgttgatcgtggctattattctgtcgaaactgttacggtaaatatgaaatattttacttaattatttttttggtattcaacttggttctgaaaatgtttttattttatttattttttacaagtcatcatgggattatttggtttggatgttctagtgaaatcttataggtcttagactaattgaccaagcttgaattatatgtttttttatcagtgatttaatatctgtttagtggattagaaaattacttagtttatcagtagtagttttttacctcaaaatttctgttttctggaccataattctaatattcctttctgtgtcatactcctacagtgagaatgattcactactattcatgctatgtgccatgtgggggttattggaattattgggtgccactattaaacttttcgtggttgtgcactgtgctatccaaaataaaaagcaccatgattttgtatgtgtaaatcatgcattatgtctgtagtataagtgggataccattgtaatacgccgacatataagtaaacattgcggagcaaaaaaaaattaaattaaacattaacatgcagagatgtgtatgacattcaaactgagtttgaggtacaagttgataatgctattttttaattgcgtattttagattgtgtatattttgcttccatatggtatttgttttgtaacatttttggtgctaattaagtcataatgcagcttttggttgcccttaaagtgcgttatcgtcagcgtattactattctgaggggaaatcatgaaagtcgccaggtctgttcttttttaaatcatgaccttcctgttagtagtggattatagattagattagatttaaaatcctattttggtaatcggaggcatggtcatttggtcagtatcagttgagttttgacagattttttcttatcaatatgctacccgtaagttcatattgctgcaatgttgccaatcaaatgctttcacacatccagatgaaagaaattctgtagtattttgggaaccaaataagctt

SEQ ID NO: 5 - DNA, 2565 bp, Glycine max
  Clone ID: 240O17_region_G3_8_mRNA
atggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctaagggacaggttattgtgatccagcttccttggaagggtttgaggggtcgaatcaccgacaaaattggtcaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctatctaatttatcctcacttacactgctgaatgcagagaacaacctccttgacaatcaaattcctcaaagtttaggtagattgcgtaatctttctgttctgattttgagtagaaaccaatttagtggacatattccttcaagtattgcaaacatttcctcgcttaggcagcttgatttgtcactgaataatttcagtggagaaattccagtctcctttgacagtcagcgcagtctaaatctcttcaatgtttcctacaatagcctctcaggttctgtcccccctctgcttgccaagaaatttaactcaagctcatttgtgggaaatattcaactatgtggatacagcccttcaaccccatgtctttcccaagctccatcacaaggagtcattgccccacctcctgaagtgtcaaaacatcaccatcataggaagctaagcaccaaagacataattctcatagtagcaggagttctcctcgtagtcctgattatactttgttgtgtcctgcttttctgcctgatcagaaagagatcaacatctaaggccgggaacggccaagccaccgagggtagagcggccactatgaggacagaaaaaggagtccctccagttgctggtggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagagcctattacttgggacccaaaggggaaaagcttctggtttttgattacatgtctaaaggaagtcttgcttctttcctacatggtggtggaactgaaacattcattgattggccaacaagaatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgtctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 6 - DNA, 2634 bp, Glycine max
  Clone ID: 240O17_region_G3_8_cds
atggatgcatgtggtatgagctcatccaattccaaacatgttgtggaccaaaagcgaagtaccatgaacatgatgatcacgacgattcttctcagattttgggaccgctatgatatgaattgcgactacactactaactcttacgagccgggaacccagttagctccttcctcaccacgtgacacttcagtgaaacttggagatgccagcagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctaagggacaggttattgtgatccagcttccttggaagggtttgaggggtcgaatcaccgacaaaattggtcaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctatctaatttatcctcacttacactgctgaatgcagagaacaacctccttgacaatcaaattcctcaaagtttaggtagattgcgtaatctttctgttctgattttgagtagaaaccaatttagtggacatattccttcaagtattgcaaacatttcctcgcttaggcagcttgatttgtcactgaataatttcagtggagaaattccagtctcctttgacagtcagcgcagtctaaatctcttcaatgtttcctacaatagcctctcaggttctgtcccccctctgcttgccaagaaatttaactcaagctcatttgtgggaaatattcaactatgtggatacagcccttcaaccccatgtctttcccaagctccatcacaaggagtcattgccccacctcctgaagtgtcaaaacatcaccatcataggaagctaagcaccaaagacataattctcatagtagcaggagttctcctcgtagtcctgattatactttgttgtgtcctgcttttctgcctgatcagaaagagatcaacatctaaggccgggaacggccaagccaccgagggtagagcggccactatgaggacagaaaaaggagtccctccagttgctggtggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagagcctattacttgggacccaaaggggaaaagcttctggtttttgattacatgtctaaaggaagtcttgcttctttcctacatggtggtggaactgaaacattcattgattggccaacaagaatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgtctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 7 - DNA, 2685 bp, Glycine max
  Clone ID: 318O13_region_A3_17_cds
atgtcgaattttctcaaatccctcactccaccgccctcgggctggtctgaaacaaccccattctgccaatggaagggtatccaatgcgattcatccagccacgtgaccagcataagcctcgcttcgcattccctcaccggaacactcccctcggatctcaattccctctctcaactccgcactctctccctccaagacaattccctcaccggcaccctcccttctctctccaacctttctttcctccaaaccgtctacttaaaccgcaacaacttctcctccgtgtcccccaccgctttcgcctccctaacctccctccaaaccctcagcctcggctccaaccctgctctccaaccctggtccttccccaccgacctcacttcctcctctaacctaatcgacctcgacctcgccaccgtatccctcaccggtcccttgccggacattttcgacaaattcccttcccttcaacaccttcgcctctcttacaacaacctcaccggcaatttaccctcctctttctccgccgccaacaatctcgaaacgctctggctcaacaaccaggccgccggcttgtccggtaccctcctcgtcctctccaacatgtctgcattaaaccagtcctggctcaataagaaccagttcaccggttccataccggatttatcgcaatgcacggctttgtctgacttgcagctcagggataaccagttaactggtgtggttcccgcttcattgacaagtcttcctagtttgaagaaagtttctctggataataatgagcttcaggggcctgtgcccgtgtttgggaaaggtgtgaatgttactctcgatgggattaatagtttttgtcttgatactcctgggaattgtgatcccagggtgatggttttgctgcagattgccgaggcattcgggtatccaattcggttggcagagtcgtggaaggggaatgatccgtgtgatggttggaactatgttgtgtgtgctgccggaaagattattactgtcaatttcgagaaacagggtttgcagggtaccatctcccctgcatttgccaatttgactgacttgaggactttgtttctcaatggcaataatttgatcggttctatacctgatagtttgatcactttgcctcagcttcagactcttgatgtgtctgacaacaacctctctggattggttcctaagttcccaccaaaggtgaagttggtgactgcgggaaatgctttgcttgggaaaccccttagtcctggaggtggaccaagtggaactactccttctgggtcttcgaccggtggaagtggtggtgaatcctcaaagggtaattcttcggtgtcgccaggttggattgctggtatagttgttattgtgttgttttttattgcagtggtgttgtttgtgtcttggaagtgttttgtcaacaagctgcaggggaagttcagtagggttaaaggtcatgaaaatgggaaaggaggctttaaacttgatgctgtccatgtttctaatggatatggtggtgttccagttgagttgcaaagccagagcagtggtgatcgcagtgaccttcatgctttagatggtccaacattttctatccaagttcttcgacaagtgacgaataatttcagcgaggagaacattttaggcaggggagggtttggagtagtttataagggggtgttgcatgatggaacaaaaattgctgttaagaggatggaatctgttgcaatggggaacaaaggtcagaaagagttcgaagcagagattgcacttcttagtaaagttaggcatagacatttggttgctcttctagggtattgcatcaatggcaatgaaaggcttttggtgtatgagtatatgcctcaaggtacattaacacagcacctgtttgagtggcaggagcatgggtatgctcctttgacttggaagcaaagggtagtaatagctttggatgtagcgcggggggtggaatacttgcacagtttagctcagcaaagcttcattcatagagacttaaaaccctcaaacatactactaggcgatgacatgagagcaaaggttgctgattttgggttggttaaaaatgcaccagatgggaagtattctgttgagacacggttggctggaacatttggatatcttgcacctgagtatgcagctactggaagagtgacaaccaaagtggatgtttatgcatttggagtagttctgatggaacttatcaccggtagaaaggcattggatgatactgtgccagatgaaaggtctcacttggtgacatggttccgtagggtactaattaacaaggaaaacattccaaaggcaattgatcaaattctcaatccagatgaggaaaccatgggaagcatatatacagtggccgagctggcaggccattgcactgctcgcgaaccataccaaaggccggatatgggtcatgcagtgaacgtcttggttcctcttgtggagcaatggaaacctactagccatgatgaagaagaggaagacggctctggcggtgaccttcatatgagccttcctcaagctctacgaaggtggcaagccaacgaaggcacttcctcaatatttaatgacatttccatctcacaaacccaatcaagcatctcctctaaacctgcagggtttgcagactcctttgattcaatggattgccgttaa

SEQ ID NO: 8 - DNA, 4523 bp, Glycine max
  CDS (113)..(264),(400)..(459),(1891)..(3713),(3925)..(4523): Clone ID: rhg1_A3244_amplicon
atggatggtaaaaattcaaaactaaaccccacacaatttagtgacacagaatataattagcgttgttctttttacagaaaacgacgagaacaaaggtgtcaaaggaaaggagatggatgcatgtggtatgagctcatccaattccaaacatgttgtggaccaaaagcgaagtaccatgaacatgatgatcacgacgattcttctcagattttgggaccgctatgatatgaattgcgactacactactaactcttacgagccggggtcatcataaaaccattaccatttaccactcttttgaacgttaatgtagcctaaatcttatatccagagaaccagaccctgtttaaatttcctttttaaaatgtttctgataaatttctcttgcaagtgtctcagaacccagttagctccttcctcaccacgtgacacttcagtgaaacttggagatgccagcaggtttatttcagccagggtctttgtctctcagggcaattcattaatttaaaaaataacatttttttatacatattcatcagtgcacgaggaggagggatagtatgtatcacactttttaattcactttctattgttttctgttagttgaaattcaaatatccctcactaatttgagactgaaacatttcaccaaaaaaaaaaaaaattgaggatggaactttcttttttagttgatcataaattttttcttctaaaatatataatgtggatacatattttttgagattgaaacctaacaaatgataaataagactcacttatttagtgagacatacatgaatttcagagaatattttcctatataggttattagcatttcttttaatattttttttattattgtcttatttttaaaaagttggcattctttttaaaattgacttttttgagatattgaactattttaataataataataaaattaagttatatagtgtattaaaaagaataagataaaatgtgttttaaatttctcaagactttagtcaaaattagtttcagtctcctctattaaaaatgtgttttaattctcatatttttaaaaatatggtgaatttcatttttaatcttgaacagttctttaattttgacttaattaaattcaacatatttcagaaacacgggaaccaaaaccaccatttttagaatccaagactataagatcttaatgacgtaaaacacaatttacccgtgagaatattaaagctagtagtattgcttttcagtgtgtttcctacggcacattgttgtgtgtggaagtggaagctagaaaacaaaggcagcagaagaagtatggtcctacaaagtgtgtagtagtgaagaagaaatagccgttggtggtggagaggcgcgggtttgcaataaaagaacagcgcgccatgatcctataataaaccctgtcaacaaaaacaagtatgcttcatgaatagttactatttacaaggaaaactagccgttactcactttttcttcttttttttttttgtaacaaattctgaaccctgcatgttcattctctctctctcacgctcgcaacccgcgcgcgcacctacacttcttttatgtcatcacgtgctccttctcactctccctctctctcactacaaaaaccattcttcaacttgcaacacacgcacacacacacactcacacacactgtttttttgttccactaaatcaaaacctcttatctcttactctcattacattcattcttttgattttcgttatggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctaagggacaggttattgtgatccagcttccttggaagggtttgaggggtcgaatcaccgacaaaattggtcaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctatctaatttatcctcacttacactgctgaatgcagagaacaacctccttgacaatcaaattcctcaaagtttaggtagattgcgtaatctttctgttctgattttgagtagaaaccaatttagtggacatattccttcaagtattgcaaacatttcctcgcttaggcagcttgatttgtcactgaataatttcagtggagaaattccagtctcctttgacagtcagcgcagtctaaatctcttcaatgtttcctacaatagcctctcaggttctgtcccccctctgcttgccaagaaatttaactcaagctcatttgtgggaaatattcaactatgtggatacagcccttcaaccccatgtctttcccaagctccatcacaaggagtcattgccccacctcctgaagtgtcaaaacatcaccatcataggaagctaagcaccaaagacataattctcatagtagcaggagttctcctcgtagtcctgattatactttgttgtgtcctgcttttctgcctgatcagaaagagatcaacatctaaggccgggaacggccaagccaccgagggtagagcggccactatgaggacagaaaaaggagtccctccagttgctggtggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagagcctattacttgggacccaaaggggaaaagcttctggtttttgattacatgtctaaaggaagtcttgcttctttcctacatggtaagtttcgtgtgctgttctttcattaagtgttgtgtgtgctgttctttaattataatttggagttttaccttagtaatctgtataattctaatcggagaacagtacaaacaaaaacacctaaggaacactatagcacctaaggaacaacaccttagctttaatataccatatcaataagtgaattattttcttgttcatcttgatgcaggtggtggaactgaaacattcattgattggccaacaagaatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgtctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 9 - DNA, 4523 bp, Glycine max; identical to SEQ ID NO: 8
  CDS (1748)..(3713),(3925)..(4523): Clone ID: rhg1_A3244_amplicon

SEQ ID NO: 10 - DNA, 4501 bp, Glycine max
  CDS (113)..(264),(400)..(459),(1888)..(3710),(3903)..(4501): Clone ID: rhg1_peking_amplicon
atggatggtaaaaattcaaaactaaaccccacacaatttagtgacacagaatataattagcgttgttctttttacagaaaacgacgagaacaaaggtgtcaaaggaaaggagatggatgcatgtggtatgagctcatccaattccaaacatgttgtggaccaaaagcgaagtaccatgaacatgatgatcacgacgattcttctcagattttgggaccgctatgatatgaattgcgactacactactaactcttacgaaccggggtcatcataaaaccattaccatttaccactcttttgaacgttaatgtagcctaaatcttatatccagagaaccagaccctgtttacatttcctttttaaaacgtttctgataaatttctcttgctagtgtctcagaacccagttagctccttcctcaccacgtgacacttcagtgaaacttggagatgccagcaggtttatttcagccagggtctttgtctctcagggcaattcattaatttaaaaaataacatttttttatacatattcatcagtgcacgaggaggagggatagtatgtatcacactttttaattcactttctattgttttctgttagttgaaattcaaatatccctcactaatttgagactgaaacatttcaccaaaaaaaaaaaaaattgaggatggaactttcttttttagttgatcataaattttttcttctaaaatatataatgtggatacatattttttgagattgaaacctaacaaatgataaataagactcacttatttagtgagacatacatgaatttcagagaatattttcctatataggttattagcatttcttttaatattttttttattattgtcttgtttttaaaaagttggcattctttttaaaattgacttttttgagatattgaactattttaataataataataaaattaagttatatagtgtattaaaaagaataagataaaatgtgttttaaatttctcaagattttagtcaaaattagtttcagtctcctctattaaaaatgtgttttaattctcatatttttaaagatatggtgaatttcatttttaatcttgaacagttctttaattttgacttaattaaattcaacatatttcagaaacacgggaaccaaaaccaccatttttagaatccaagactaaagatcttaatgacgtaaaacacaatttacccgtgagaatattaaagctagtagtattgcttttcagtgtgtttcctacggcacattgttgtgtgtggaagtggaagctagaaaacaaaggcagcagaagaagtatggtcctacaaagtgtgtagtagtgaagaagaaatagccgttggtggtggagaggcgcgggtttgcaataaaagaacagcgcgccatgatcctataataaaccctgtcaacaaaaacaagtatgcttcatgaatagttactatttacaaggaaaactagccgttactcactttttcttcttttttttttttgtaacaaattctgaaccctgcatgttcattctctctctctcacgctcgcaacccgcgcgcgcacctacacttcttttatgtcatcacgtgctccttctcactctccctctctctcactacaaaaaccattcttcaacttgcaacacacgcacacacacactcacacacactgtttttttgttccactaaatcaaaacctcttatctcttactctcattacattcattcttttgattttcgttatggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggctgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctcctttgacagtcagcgcagtctaaatctcttcaatgtttcctacaatagcctctcaggttctgtcccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagtcctgattatactttgttgtgtcctgcttttctgcctgatcagaaagagatcaacatctaaggccgggaacggccaagccaccgagggtagagcggccactatgaggacagaaaaaggagtccctccagttgctggtggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtaagtttcgtgtgctgttctttcattaagtgttgtgtgtgctgttctttaattataatttggagttttaccttagtaatctgtataattctaatcggagaacagtacaaacaaaaacacctaaggaacaacaccttagctttaatataccatatcaataagtgaattattttcttgttcatcttgatgcaggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgtctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 11 - DNA, 4501 bp, Glycine max; identical to SEQ ID NO: 10
  CDS (1745)..(3710),(3903)..(4501): Clone ID: rhg1_peking_amplicon

SEQ ID NO: 12 - DNA, 4522 bp, Glycine max
  CDS (113)..(264),(400)..(459),(1890)..(3712),(3924)..(4522): Clone ID: rhg1_toyosuzu_amplicon
atggatggtaaaaattcaaaactaaaccccacacaatttagtgacacagaatataattagcgttgttctttttacagaaaacgacgagaacaaaggtgtcaaaggaaaggagatggatgcatgtggtatgagctcatccaattccaaacatgttgtggaccaaaagcgaagtaccatgaacatgatgatcacgacgattcttctcagattttgggaccgctatgatatgaattgcgactacactactaactcttacgaaccggggtcatcataaaaccattaccatttaccactcttttgaacgttaatgtagcctaaatcttatatccagagaaccagaccctgtttaaatttcctttttaaaatgtttctgataaatttctcttgcaagtgtctcagaacccagttagctccttcctcaccacgtgacacttcagtgaaacttggagatgccagcaggtttatttcagccagggtctttgtctctcagggcaattcattaatttaaaaaataacatttttttatacatattcatcagtgcacgaggaggagggatagtatgtatcacactttttaattcactttctattgttttctgttagttgaaattcaaatatccctcactaatttgagactgaaacatttcaccaaaaaaaaaaaaaattgaggatggaactttcttttttagttgatcataaattttttcttctaaaatatataatgtggatacatattttttgagattgaaacctaacaaatgataaataagactcacttatttagtgagacatacatgaatttcagagaatattttcctatataggttattagcatttcttttaatattttttttattattgtcttgtttttaaaaagttggcattctttttaaaattgacttttttgagatattgaactattttaataataataataaaattaagttatatagtgtattaaaaagaataagataaaatgtgttttaaatttctcaagattttagtcaaaattagtttcagtctcctctattaaaaatgtgttttaattctcatatttttaaagatatggtgaatttcatttttaatcttgaacagttctttaattttgacttaattaaattcaacatatttcagaaacacgggaaccaaaaccaccatttttagaatccaagactaaagatcttaatgacgtaaaacacaatttacccgtgagaatattaaagctagtagtattgcttttcagtgtgtttcctacggcacattgttgtgtgtggaagtggaagctagaaaacaaaggcagcagaagaagtatggtcctacaaagtgtgtagtagtgaagaagaaatagccgttggtggtggagaggcgcgggtttgcaataaaagaacagcgcgccatgatcctataataaaccctgtcaacaaaaacaagtatgcttcatgaatagttactatttacaaggaaaactagccgttactcactttttcttcttttttttttttgtaacaaattctgaaccctgcatgttcattctctctctctcacgctcgcaacccgcgcgcgcacctacacttcttttatgtcatcacgtgctccttctcactctccctctctctcactacaaaaaccattcttcaacttgcaacacacgcacacacacacactcacacacactgtttttttgttccactaaatcaaaacctcttatctcttactctcattacattcattcttttgattttcgttatggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctcctttgacagtcagcgcagtctaaatctcttcaatgtttcctacaatagcctctcaggttctgtcccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagtcctgattatactttgttgtgtcctgcttttctgcctgatcagaaagagatcaacatctaaggccgggaacggccaagccaccgagggtagagcggccactatgaggacagaaaaaggagtccctccagttgctggtggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagagcctattacttgggacccaaaggggaaaagcttctggtttttgattacatgtctaaaggaagtcttgcttctttcctacatggtaagtttcgtgtgctgttctttcattaagtgttgtgtgtgctgttctttaattataatttggagttttaccttagtaatctgtataattctaatcggagaacagtacaaacaaaaacacctaaggaacactatagcacctaaggaacaacaccttagctttaatataccatatcaataagtgaattattttcttgttcatcttgatgcaggtggtggaactgaaacattcattgattggccaacaagaatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgtctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 13 - DNA, 4522 bp, Glycine max; identical to SEQ ID NO: 12
  CDS (1747)..(3712),(3924)..(4522): Clone ID: rhg1_toyosuzu_amplicon

SEQ ID NO: 14 - DNA, 4523 bp, Glycine max; identical to SEQ ID NO: 8
  CDS (113)..(264),(400)..(459),(1891)..(3713),(3925)..(4523): Clone ID: rhg1_will_amplicon

SEQ ID NO: 15 - DNA, 4523 bp, Glycine max; identical to SEQ ID NO: 8
  CDS (1748)..(3713),(3925)..(4523): Clone ID: rhg1_will_amplicon

SEQ ID NO: 16 - DNA, 4523 bp, Glycine max
  CDS (113)..(264),(400)..(459),(1891)..(3713),(3925)..(4523): Clone ID: rhg1_a2704_amplicon
atggatggtaaaaattcaaaactaaaccccacacaatttagtgacacagaatataattagcgttgttctttttacagaaaacgacgagaacaaaggtgtcaaaggaaaggagatggatgcatgtggtatgagctcatccaattccaaacatgttgtggaccaaaagcgaagtaccatgaacatgatgatcacgacgattcttctcagattttgggaccgctatgatatgaattgcgactacactactaactcttacgagccggggtcatcataaaaccattaccatttaccactcttttgaacgttaatgtagcctaaatcttatatccagagaaccagaccctgtttaaatttcctttttaaaatgtttctgataaatttctcttgcaagtgtctcagaacccagttagctccttcctcaccacgtgacacttcagtgaaacttggagatgccagcaggtttatttcagccagggtctttgtctctcagggcaattcattaatttaaaaaataacatttttttatacatattcatcagtgcacgaggaggagggatagtatgtatcacactttttaattcactttctattgttttctgttagttgaaattcaaatatccctcactaatttgagactgaaacatttcaccaaaaaaaaaaaaaattgaggatggaactttcttttttagttgatcataaattttttcttctaaaatatataatgtggatacatattttttgagattgaaacctaacaaatgataaataagactcacttatttagtgagacatacatgaatttcagagaatattttcctatataggttattagcatttcttttaatattttttttattattgtcttatttttaaaaagttggcattctttttaaaattgacttttttgagatattgaactattttaataataataataaaattaagttatatagtgtattaaaaagaataagataaaatgtgttttaaatttctcaagactttagtcaaaattagtttcagtctcctctattaaaaatgtgttttaattctcatatttttaaaaatatggtgaatttcatttttaatcttgaacagttctttaattttgacttaattaaattcaacatatttcagaaacacgggaaccaaaaccaccatttttagaatccaagactataagatcttaatgacgtaaaacacaatttacccgtgagaatattaaagctagtagtattgcttttcagtgtgtttcctacggcacattgttgtgtgtggaagtggaagctagaaaacaaaggcagcagaagaagtatggtcctacaaagtgtgtagtagtgaagaagaaatagccgttggtggtggagaggcgcgggtttgcaataaaagaacagcgcgccatgatcctataataaaccctgtcaacaaaaacaagtatgcttcatgaatagttactatttacaaggaaaactagccgttactcactttttcttcttttttttttttgtaacaaattctgaaccctgcatgttcattctctctctctcacgctcgcaacccgcgcgcgcacctacacttcttttatgtcatcacgtgctccttctcactctccctctctctcactacaaaaaccattcttcaacttgcaacacacgcacacacacacactcacacacactgtttttttgttccactaaatcaaaacctcttatctcttactctcattacattcattcttttgattttcgttatggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctaagggacaggttattgtgatccagcttccttggaagggtttgaggggtcgaatcaccgacaaaattggtcaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctatctaatttatcctcacttacactgctgaatgcagagaacaacctccttgacaatcaaattcctcaaagtttaggtagattgcgtaatctttctgttctgattttgagtagaaaccaatttagtggacatattccttcaagtattgcaaacatttcctcgcttaggcagcttgatttgtcactgaataatttcagtggagaaattccagtctccttcgacagtcagcgcagtctaaatctcttcaatgtttcctacaatagcctttcaggttctgttccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagttctgattatactttgttgtgtcctgcttttctgcctgatcagaaagagatcaacatctaaggccgggaacggccaagccaccgagggtagagcggccactatgaggacagaaaaaggagtccctccagttgctgctggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtaagtttcgtgtgctgttctttcattaagtgttgtgtgtgctgttctttaattataatttggagttttaccttagtaatctgtataattctaatcggagaacagtacaaacaaaaacacctaaggaacactatagcacctaaggaacaacaccttagctttaatataccatatcaataagtgaattattttcttgttcatcttgatgcaggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgcctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 17 - DNA, 4523 bp, Glycine max; identical to SEQ ID NO: 16
  CDS (1748)..(3713),(3925)..(4523): Clone ID: rhg1_a2704_amplicon

SEQ ID NO: 18 - DNA, 4508 bp, Glycine max
  CDS (113)..(264),(400)..(459),(1876)..(3698),(3910)..(4508): Clone ID: rhg1_noir_amplicon
atggatggtaaaaattcaaaactaaaccccacacaatttagtgacacagaatataattagcgttgttctttttacagaaaacgacgagaacaaaggtgtcaaaggaaaggagatggatgcatatggtatgagctcatccaattccaaacatgttgtggaccaaaagcgaagtaccatgaacatgatgatcacgacgattcttctcagattttgggaccgctatgatatgaattgcgactacactactaactcttacgaaccggggtcatcataaaaccattaccatttaccactcttttgaacgttaatgtagcctaaatcttatatccagagaaccagaccctgtttaaatttcctttttaaaacgtttctgataaatttctcttgctagtgtctcagaacccagttagctccttcctcaccacgtgacacttcagtgaaacttggagatgccagcaggtttatttcagccagggtctttgtctctcagggcaattcattaatttaaaaaataacatttttttatacatattcatcagtgcacgaggaggagggatagtgtgtatcacactttttaattcactttctattgttttctgttagttgaaattcaaatatccctcactaatttgagactgaaacatttcaccaaaaaaaaaaaaaattgaggatggaactttcttttttagttgatcataaattttttcttctaaaatatataatgtggatacatattttttgagattgaaacctaacaaatgataaataagactcacttatttagtgagacatacatgaatttcagagaatattttcctatataggttattagcatttcttttaatattttttttattattgtcttatttttaaaaagttggcattctttttaaaattgacttttttgtgatattgaactattttaataataataataaaattaagttatatagtgtattaaaaagaataagataaaatgtgttttaaatttctcaagattttagtcaaaattagtttcagtctcctctattaaaaatgtgttttaattctcatatttttaaaaatatggtgaatttcatttttaatcttgaacagttctttaattttgacttaattaaattcaacatatttcagaaacacgggaaccaaaaccaccatttttagaatccaagactaaagatcttaatgacgtaaaacacaatttacccgtgagaatattaaagctagtagtattgcttttcagtgtgtttcctacggcacattgttgtgtgtggaagtggaagctagaaaacaaaggcagcagaagaagtatggtcctacaaagtgtgtagtagtgaagaagaaatagccgttggtggtggagaggcgcgggtttgcaataaaagaacagcgcgccatgatcctataataaaccctgtcaacaaaaacaagtatgcttcatgaatagttactatttacaaggaaaactagccgttactcactttttcttcttttttttttttgtaacaaattctgaaccctgcatgttcattctctctctctcacgctcgcaacccgcgcgcgcacctacacttcttttatgtcatcacgtgctccttctcactctccctctctctcactacaaaaaccattcttcaacttgcaacacacgcacacacactgtttttttgttccactaaatcaaaacctcttatctcttactctcattacattcattcttttgattttcgttatggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtggaaattccaagaatggcttctttaggcttcaaaatttgatcctagataataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctccttcgacagtcagcgcagtctaaatctcttcaatgtttcctacaatagcctttcaggttctgttccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagttctgattatactttgttgtgtcctgcttttctgcctgatcagaaagagatcaacatctaaggccgggaacggccaagccaccgagggtagagcggccactatgaggacagaaaaaggagtccctccagttgctgctggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtaagtttcgtgtgctgttctttcattaagtgttgtgtgtgctgttctttaattataatttggagttttaccttagtaatctgtataattctaatcggagaacagtacaaacaaaaacacctaaggaacactatagcacctaaggaacaacaccttagctttaatataccatatcaataagtgaattattttcttgttcatcttgatgcaggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgcctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 19 - DNA, 4508 bp, Glycine max; identical to SEQ ID NO: 18
  CDS (1733)..(3698),(3910)..(4508): Clone ID: rhg1_noir_amplicon

SEQ ID NO: 20 - DNA, 4508 bp, Glycine max
  CDS (113)..(264),(400)..(459),(1876)..(3698),(3910)..(4508): Clone ID: rhg1_lee_amplicon
atggatggtaaaaattcaaaactaaaccccacacaatttagtgacacagaatataattagcgttgttctttttacagaaaacgacgagaacaaaggtgtcaaaggaaaggagatggatgcatatggtatgagctcatccaattccaaacatgttgtggaccaaaagcgaagtaccatgaacatgatgatcacgacgattcttctcagattttgggaccgctatgatatgaattgcgactacactactaactcttacgaaccggggtcatcataaaaccattaccatttaccactcttttgaacgttaatgtagcctaaatcttatatccagagaaccagaccctgtttaaatttcctttttaaaacgtttctgataaatttctcttgctagtgtctcagaacccagttagctccttcctcaccacgtgacacttcagtgaaacttggagatgccagcaggtttatttcagccagggtctttgtctctcagggcaattcattaatttaaaaaataacatttttttatacatattcatcagtgcacgaggaggagggatagtgtgtatcacactttttaattcactttctattgttttctgttagttgaaattcaaatatccctcactaatttgagactgaaacatttcaccaaaaaaaaaaaaaattgaggatggaactttcttttttagttgatcataaattttttcttctaaaatatataatgtggatacatattttttgagattgaaacctaacaaatgataaataagactcacttatttagtgagacatacatgaatttcagagaatattttcctatataggttattagcatttcttttaatattttttttattattgtcttatttttaaaaagttggcattctttttaaaattgacttttttgtgatattgaactattttaataataataataaaattaagttatatagtgtattaaaaagaataagataaaatgtgttttaaatttctcaagattttagtcaaaattagtttcagtctcctctattaaaaatgtgttttaattctcatatttttaaaaatatggtgaatttcatttttaatcttgaacagttctttaattttgacttaattaaattcaacatatttcagaaacacgggaaccaaaaccaccatttttagaatccaagactaaagatcttaatgacgtaaaacacaatttacccgtgagaatattaaagctagtagtattgcttttcagtgtgtttcctacggcacattgttgtgtgtggaagtggaagctagaaaacaaaggcagcagaagaagtatggtcctacaaagtgtgtagtagtgaagaagaaatagccgttggtggtggagaggcgcgggtttgcaataaaagaacagcgcgccatgatcctataataaaccctgtcaacaaaaacaagtatgcttcatgaatagttactatttacaaggaaaactagccgttactcactttttcttcttttttttttttgtaacaaattctgaaccctgcatgttcattctctctctctcacgctcgcaacccgcgcgcgcacctacacttcttttatgtcatcacgtgctccttctcactctccctctctctcactacaaaaaccattcttcaacttgcaacacacgcacacacactgtttttttgttccactaaatcaaaacctcttatctcttactctcattacattcattcttttgattttcgttatggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagataataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctccttcgacagtcagcgcagtctaaatctcttcaatgtttcctacaatagcctttcaggttctgttccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagttctgattatactttgttgtgtcctgcttttctgcctgatcagaaagagatcaacatctaaggccgggaacggccaagccaccgagggtagagcggccactatgaggacagaaaaaggagtccctccagttgctgctggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtaagtttcgtgtgctgttctttcattaagtgttgtgtgtgctgttctttaattataatttggagttttaccttagtaatctgtataattctaatcggagaacagtacaaacaaaaacacctaaggaacactatagcacctaaggaacaacaccttagctttaatataccatatcaataagtgaattattttcttgttcatcttgatgcaggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgcctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 21 - DNA, 4508 bp, Glycine max; identical to SEQ ID NO: 20
  CDS (1733)..(3698),(3910)..(4508): Clone ID: rhg1_lee_amplicon

SEQ ID NO: 22 - DNA, 4508 bp, Glycine max
  CDS (113)..(264),(400)..(459),(1876)..(3698),(3910)..(4508): Clone ID: rhg1_pi200499_amplicon
atggatggtaaaaattcaaaactaaaccccacacaatttagtgacacagaatataattagcgttgttctttttacagaaaacgacgagaacaaaggtgtcaaaggaaaggagatggatgcatgtggtatgagctcatccaattccaaacatgttgtggaccaaaagcgaagtaccatgaacatgatgatcacgacgattcttctcagattttgggaccgctatgatatgaattgcgactacactactaactcttacgaaccggggtcatcataaaaccattaccatttaccactcttttgaacgttaatgtagcctaaatcttatatccagagaaccagaccctgtttaaatttcctttttaaaacgtttctgataaatttctcttgcaagtgtctcagaacccagttagctccttcctcaccacgtgacacttcagtgaaacttggagatgccagcaggtttatttcagccagggtctttgtctctcagggcaattcattaatttaaaaaataacatttttttatacatattcatcagtgcacgaggaggagggatagtatgtatcacactttttaattcactttctattgttttctgttagttgaaattcaaatatccctcactaatttgagactgaaacatttcaccaaaaaaaaaaaaaattgaggatggaactttcttttttagttgatcataaattttttcttctaaaatatataatgtggatacatattttttgagattgaaacctaacaaatgataaataagactcacttatttagtgagacatacatgaatttcagagaatattttcctatataggttattagcatttcttttaatattttttttattattgtcttatttttaaaaagttggcattctttttaaaattgacttttttgagatattgaactattttaataataataataaaattaagttatatagtgtattaaaaagaataagataaaatgtgttttaaatttctcaagattttagtcaaaattagtttcagtctcctctattaaaaatgtgttttaattctcatatttttaaaaatatggtgaatttcatttttaatcttgaacagttctttaattttgacttaattaaattcaacatatttcagaaacacgggaaccaaaaccaccatttttagaatccaagactaaagatcttaatgacgtaaaacacaatttacccgtgagaatattaaagctagtagtattgcttttcagtgtgtttcctacggcacattgttgtgtgtggaagtggaagctagaaaacaaaggcagcagaagaagtatggtcctacaaagtgtgtagtagtgaagaagaaatagccgttggtggtggagaggcgcgggtttgcaataaaagaacagcgcgccatgatcctataataaaccctgtcaacaaaaacaagtatgcttcatgaatagttactatttacaaggaaaactagccgttactcactttttcttcttttttttttttgtaacaaattctgaaccctgcatgttcattctctctctctcacgctcgcaacccgcgcgcgcacctacacttcttttatgtcatcacgtgctccttctcactctccctctctctcactacaaaaaccattcttcaacttgcaacacacgcacacacactgtttttttgttccactaaatcaaaacctcttatctcttactctcattacattcattcttttgattttcgttatggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagataataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctccttcgacagtcagcgcagtctaaatctcttcaatgtttcctacaatagcctttcaggttctgttccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagttctgattatactttgttgtgtcctgcttttctgcctgatcagaaagagatcaacatctaaggccgggaacggccaagccaccgagggtagagcggccactatgaggacagaaaaaggagtccctccagttgctgctggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtaagtttcgtgtgctgttctttcattaagtgttgtgtgtgctgttctttaattataatttggagttttaccttagtaatctgtataattctaatcggagaacagtacaaacaaaaacacctaaggaacactatagcacctaaggaacaacaccttagctttaatataccatatcaataagtgaattattttcttgttcatcttgatgcaggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgcctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 23 - DNA, 4508 bp, Glycine max; identical to SEQ ID NO: 22
  CDS (1733)..(3698),(3910)..(4508): Clone ID: rhg1_pi200499_amplicon

SEQ ID NO: 24 - DNA, 27 bp, Glycine max
  Clone ID: 240O17_region_G3_forward_1
atggatggtaaaaattcaaaactaaac

SEQ ID NO: 25 - DNA, 25 bp, Glycine max
  Clone ID: 240O17_region_G3_reverse_1
gcaatacttgaaggaatatgtccac

SEQ ID NO: 26 - DNA, 24 bp, Glycine max
  Clone ID: 240O17_region_G3_forward_2
ctcacttacactgctgaatgcaga

SEQ ID NO: 27 - DNA, 23 bp, Glycine max
  Clone ID: 240O17_region_G3_reverse_2
gactggctgtgactgatctctct

SEQ ID NO: 28 - DNA, 2634 bp, Glycine max; identical to SEQ ID NO: 6
  Clone ID: rhg1_A3244_amplicon_cds

SEQ ID NO: 29 - DNA, 2634 bp, Glycine max
  Clone ID: rhg1_peking_amplicon_cds
atggatgcatgtggtatgagctcatccaattccaaacatgttgtggaccaaaagcgaagtaccatgaacatgatgatcacgacgattcttctcagattttgggaccgctatgatatgaattgcgactacactactaactcttacgaaccgggaacccagttagctccttcctcaccacgtgacacttcagtgaaacttggagatgccagcagccttgttgtgctcccctcatgcgtgaggccagttttgtgtgaagatgaaggttgggatggagtggttgtgacagcatcaaacctcttagcacttgaagctttcaagcaagagttggctgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctcctttgacagtcagcgcagtctaaatctcttcaatgtttcctacaatagcctctcaggttctgtcccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagtcctgattatactttgttgtgtcctgcttttctgcctgatcagaaagagatcaacatctaaggccgggaacggccaagccaccgagggtagagcggccactatgaggacagaaaaaggagtccctccagttgctggtggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgtctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 30 - DNA, 2634 bp, Glycine max
  Clone ID: rhg1_toyosuzu_amplicon_cds
atggatgcatgtggtatgagctcatccaattccaaacatgttgtggaccaaaagcgaagtaccatgaacatgatgatcacgacgattcttctcagattttgggaccgctatgatatgaattgcgactacactactaactcttacgaaccgggaacccagttagctccttcctcaccacgtgacacttcagtgaaacttggagatgccagcagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctcctttgacagtcagcgcagtctaaatctcttcaatgtttcctacaatagcctctcaggttctgtcccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagtcctgattatactttgttgtgtcctgcttttctgcctgatcagaaagagatcaacatctaaggccgggaacggccaagccaccgagggtagagcggccactatgaggacagaaaaaggagtccctccagttgctggtggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagagcctattacttgggacccaaaggggaaaagcttctggtttttgattacatgtctaaaggaagtcttgcttctttcctacatggtggtggaactgaaacattcattgattggccaacaagaatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgtctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 31 - DNA, 2634 bp, Glycine max; identical to SEQ ID NO: 6
  Clone ID: rhg1_will_amplicon_cds

SEQ ID NO: 32 - DNA, 2634 bp, Glycine max
  Clone ID: rhg1_a2704_amplicon_cds
atggatgcatgtggtatgagctcatccaattccaaacatgttgtggaccaaaagcgaagtaccatgaacatgatgatcacgacgattcttctcagattttgggaccgctatgatatgaattgcgactacactactaactcttacgagccgggaacccagttagctccttcctcaccacgtgacacttcagtgaaacttggagatgccagcagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctaagggacaggttattgtgatccagcttccttggaagggtttgaggggtcgaatcaccgacaaaattggtcaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctatctaatttatcctcacttacactgctgaatgcagagaacaacctccttgacaatcaaattcctcaaagtttaggtagattgcgtaatctttctgttctgattttgagtagaaaccaatttagtggacatattccttcaagtattgcaaacatttcctcgcttaggcagcttgatttgtcactgaataatttcagtggagaaattccagtctccttcgacagtcagcgcagtctaaatctcttcaatgtttcctacaatagcctttcaggttctgttccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagttctgattatactttgttgtgtcctgcttttctgcctgatcagaaagagatcaacatctaaggccgggaacggccaagccaccgagggtagagcggccactatgaggacagaaaaaggagtccctccagttgctgctggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgcctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 33 - DNA, 2634 bp, Glycine max
  Clone ID: rhg1_noir_amplicon_cds
atggatgcatatggtatgagctcatccaattccaaacatgttgtggaccaaaagcgaagtaccatgaacatgatgatcacgacgattcttctcagattttgggaccgctatgatatgaattgcgactacactactaactcttacgaaccgggaacccagttagctccttcctcaccacgtgacacttcagtgaaacttggagatgccagcagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtggaaattccaagaatggcttctttaggcttcaaaatttgatcctagataataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctccttcgacagtcagcgcagtctaaatctcttcaatgtttcctacaatagcctttcaggttctgttccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagttctgattatactttgttgtgtcctgcttttctgcctgatcagaaagagatcaacatctaaggccgggaacggccaagccaccgagggtagagcggccactatgaggacagaaaaaggagtccctccagttgctgctggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgcctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 34 - DNA, 2634 bp, Glycine max
  Clone ID: rhg1_lee_amplicon_cds
atggatgcatatggtatgagctcatccaattccaaacatgttgtggaccaaaagcgaagtaccatgaacatgatgatcacgacgattcttctcagattttgggaccgctatgatatgaattgcgactacactactaactcttacgaaccgggaacccagttagctccttcctcaccacgtgacacttcagtgaaacttggagatgccagcagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagataataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctccttcgacagtcagcgcagtctaaatctcttcaatgtttcctacaatagcctttcaggttctgttccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagttctgattatactttgttgtgtcctgcttttctgcctgatcagaaagagatcaacatctaaggccgggaacggccaagccaccgagggtagagcggccactatgaggacagaaaaaggagtccctccagttgctgctggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgcctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 35 - DNA, 2634 bp, Glycine max
  Clone ID: rhg1_pi200499_amplicon_cds
atggatgcatgtggtatgagctcatccaattccaaacatgttgtggaccaaaagcgaagtaccatgaacatgatgatcacgacgattcttctcagattttgggaccgctatgatatgaattgcgactacactactaactcttacgaaccgggaacccagttagctccttcctcaccacgtgacacttcagtgaaacttggagatgccagcagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagataataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctccttcgacagtcagcgcagtctaaatctcttcaatgtttcctacaatagcctttcaggttctgttccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagttctgattatactttgttgtgtcctgcttttctgcctgatcagaaagagatcaacatctaaggccgggaacggccaagccaccgagggtagagcggccactatgaggacagaaaaaggagtccctccagttgctgctggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgcctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 36 - DNA, 2565 bp, Glycine max; identical to SEQ ID NO: 5
  Clone ID: rhg1_A3244_amplicon_cds_2

SEQ ID NO: 37 - DNA, 2565 bp, Glycine max
  Clone ID: rhg1_peking_amplicon_cds_2
atggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggctgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctcctttgacagtcagcgcagtctaaatctcttcaatgtttcctacaatagcctctcaggttctgtcccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagtcctgattatactttgttgtgtcctgcttttctgcctgatcagaaagagatcaacatctaaggccgggaacggccaagccaccgagggtagagcggccactatgaggacagaaaaaggagtccctccagttgctggtggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgtctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 38 - DNA, 2565 bp, Glycine max
  Clone ID: rhg1_toyosuzu_amplicon_cds_2
atggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctcctttgacagtcagcgcagtctaaatctcttcaatgtttcctacaatagcctctcaggttctgtcccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagtcctgattatactttgttgtgtcctgcttttctgcctgatcagaaagagatcaacatctaaggccgggaacggccaagccaccgagggtagagcggccactatgaggacagaaaaaggagtccctccagttgctggtggtgatgttgaagcaggtggggaggctggagggaaactagtccattttgatggaaccaatggcttttacagctgatgatctctgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagagcctattacttgggacccaaaggggaaaagcttctggtttttgattacatgtctaaaggaagtcttgcttctttcctacatggtggtggaactgaaacattcattgattggccaacaagaatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgtctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 39 - DNA, 2565 bp, Glycine max; identical to SEQ ID NO: 5
  Clone ID: rhg1_will_amplicon_cds_2

SEQ ID NO: 40 - DNA, 2565 bp, Glycine max
  Clone ID: rhg1_a2704_amplicon_cds_2
atggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctaagggacaggttattgtgatccagcttccttggaagggtttgaggggtcgaatcaccgacaaaattggtcaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagatcataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctatctaatttatcctcacttacactgctgaatgcagagaacaacctccttgacaatcaaattcctcaaagtttaggtagattgcgtaatctttctgttctgattttgagtagaaaccaatttagtggacatattccttcaagtattgcaaacatttcctcgcttaggcagcttgatttgtcactgaataatttcagtggagaaattccagtctccttcgacagtcagcgcagtctaaatctcttcaatgtttcctacaatagcctttcaggttctgttccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagttctgattatactttgttgtgtcctgcttttctgcctgatcagaaagagatcaacatctaaggccgggaacggccaagccaccgagggtagagcggccactatgaggacagaaaaaggagtccctccagttgctgctggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgcctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 41 - DNA, 2565 bp, Glycine max
  Clone ID: rhg1_noir_amplicon_cds_2
atggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtggaaattccaagaatggcttctttaggcttcaaaatttgatcctagataataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctccttcgacagtcagcgcagtctaaatctcttcaatgtttcctacaatagcctttcaggttctgttccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagttctgattatactttgttgtgtcctgcttttctgcctgatcagaaagagatcaacatctaaggccgggaacggccaagccaccgagggtagagcggccactatgaggacagaaaaaggagtccctccagttgctgctggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgcctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 42 - DNA, 2565 bp, Glycine max
  Clone ID: rhg1_lee_amplicon_cds_2
atggtagtagcagtggagaaaaccaacctcacttcacaatcacaatgcttcaaccgtgtttctgacaagaagaaagaaagatgcaagacacacatgaacaacgttaacccatgttgttttttgtttctcttatgtgtgtggagccttgttgtgctcccctcatgcgtgaggccagttttgtgtgaagatgaaggttgggatggagtggttgtgacagcatcaaacctcttagcacttgaagctttcaagcaagagttggttgatccagaagggttcttgcggagctggaatgacagtggctatggagcttgttccggaggttgggttggaatcaagtgtgctcagggacaggttattgtgatccagcttccttggaagggtttgaggggtcgaatcaccgacaaaattggccaacttcaaggcctcaggaagcttagtcttcatgataaccaaattggtggttcaatcccttcaactttgggacttcttcccaaccttagaggggttcagttattcaacaataggcttacaggttccatacctctttctttaggtttctgccctttgcttcagtctcttgacctcagcaacaacttgctcacaggagcaatcccttatagtcttgctaattccactaagctttattggcttaacttgagtttcaactccttctctggtcctttaccagctagcctaactcactcattttctctcacttttctttctcttcaaaataacaatctttctggctcccttcctaactcttggggtgggaattccaagaatggcttctttaggcttcaaaatttgatcctagataataactttttcactggtgacgttcctgcttctttgggtagcttaagagagctcaatgagatttcccttagtcataataagtttagtggagctataccaaatgaaataggaaccctttctaggcttaagacacttgacatttctaataatgccttgaatgggaacttgcctgctaccctctctaatttatcctcacttacactgctgaatgcagagaacaacctccttgacaatcaaatccctcaaagtttaggtagattgcgtaatctttctgttctgattttgagtagaaaccaatttagtggacatattccttcaagcattgcaaacatttcctcgcttaggcagcttgatttgtcactgaataatttcagtggagaaattccagtctccttcgacagtcagcgcagtctaaatctcttcaatgtttcctacaatagcctttcaggttctgttccccctctgcttgccaagaaatttaactcaagctcatttgtgggaaatattcaactatgtgggtacagcccttcaaccccatgtctttcccaagctccatcacaaggagtcattgccccacctcctgaagtgtcaaaacatcaccatcataggaagctaagcaccaaagacataattctcatagtagcaggagttctcctcgtagttctgattatactttgttgtgtcctgcttttctgcctgatcagaaagagatcaacatctaaggccgggaacggccaagccaccgagggtagagcggccactatgaggacagaaaaaggagtccctccagttgctgctggtgatgttgaagcaggtggggaggctggagggaaactagtccattttgatggaccaatggcttttacagctgatgatctcttgtgtgcaacagctgagatcatgggaaagagcacctatggaactgtttataaggctattttggaggatggaagtcaagttgcagtaaagagattgagggaaaagatcactaaaggtcatagagaatttgaatcagaagtcagtgttctaggaaaaattagacaccccaatgttttggctctgagggcctattacttgggacccaaaggggaaaagcttctggtttttgattacatgtctaaaggaagtcttgcttctttcctacatggtggtggaactgaaacattcattgattggccaacaaggatgaaaatagcacaagacttggcccgtggcttgttctgccttcattcccaggagaacatcatacatgggaacctcacatccagcaatgtgttgcttgatgagaatacaaatgctaaaattgcagattttggtctttctcggttgatgtcaactgctgctaattccaacgtgatagctacagctggagcattgggataccgggcacctgagctctcaaagctcaagaaagcaaacactaaaactgatatctacagtcttggtgttatcttgttagaactcctaacgaggaaatcacctggggtgcctatgaatggactagatttgcctcagtgggttgcctcagttgtcaaagaggagtggacaaatgaggtttttgatgcagacttgatgagagatgcatccacagttggcgacgagttgctaaacacgttgaagctcgctttgcactgtgttgatccttctccatcagcacgaccagaagttcatcaagttctccagcagctggaagagattagaccagagagatcagtcacagccagtcccggggacgatatcgtatag

SEQ ID NO: 43 - DNA, 2565 bp, Glycine max; identical to SEQ ID NO: 42
  Clone ID: rhg1_pi200499_amplicon_cds_2

SEQ ID NO: 44 - DNA, 3480 bp, Glycine max
  CDS (79)..(2242),(2958)..(3478): Clone ID: rhg4_a3244_amplicon
atgtctctccccaaaaccctactttctctcttccttctcctcacgatccccctagtaaccgccgatgacgccgcggtgatgtcgaattttctcaaatccctcactccaccgccctcgggctggtctgaaacaaccccattctgccaatggaagggtatccaatgcgattcatccagccacgtgaccagcataagcctcgcttcgcattccctcaccggaacactcccctcggatctcaattccctctctcaactccgcactctctccctccaagacaattccctcaccggcaccctcccttctctctccaacctttctttcctccaaaccgtctacttaaaccgcaacaacttctcctccgtgtcccccaccgctttcgcctccctaacctccctccaaaccctcagcctcggctccaaccctgctctccaaccctggtccttccccaccgacctcacttcctcctctaacctaatcgacctcgacctcgccaccgtatccctcaccggtcccttgccggacattttcgacaaattcccttcccttcaacaccttcgcctctcttacaacaacctcaccggcaatttaccctcctctttctccgccgccaacaatctcgaaacgctctggctcaacaaccaggccgccggcttgtccggtaccctcctcgtcctctccaacatgtctgcattaaaccagtcctggctcaataagaaccagttcaccggttccataccggatttatcgcaatgcacggctttgtctgacttgcagctcagggataaccagttaactggtgtggttcccgcttcattgacaagtcttcctagtttgaagaaagtttctctggataataatgagcttcaggggcctgtgcccgtgtttgggaaaggtgtgaatgttactctcgatgggattaatagtttttgtcttgatactcctgggaattgtgatcccagggtgatggttttgctgcagattgccgaggcattcgggtatccaattcggttggcagagtcgtggaaggggaatgatccgtgtgatggttggaactatgttgtgtgtgctgccggaaagattattactgtcaatttcgagaaacagggtttgcagggtaccatctcccctgcatttgccaatttgactgacttgaggactttgtttctcaatggcaataatttgatcggttctatacctgatagtttgatcactttgcctcagcttcagactcttgatgtgtctgacaacaacctctctggattggttcctaagttcccaccaaaggtgaagttggtgactgcgggaaatgctttgcttgggaaaccccttagtcctggaggtggaccaagtggaactactccttctgggtcttcgaccggtggaagtggtggtgaatcctcaaagggtaattcttcggtgtcgccaggttggattgctggtatagttgttattgtgttgttttttattgcagtggtgttgtttgtgtcttggaagtgttttgtcaacaagctgcaggggaagttcagtagggttaaaggtcatgaaaatgggaaaggaggctttaaacttgatgctgtccatgtttctaatggatatggtggtgttccagttgagttgcaaagccagagcagtggtgatcgcagtgaccttcatgctttagatggtccaacattttctatccaagttcttcgacaagtgacgaataatttcagcgaggagaacattttaggcaggggagggtttggagtagtttataagggggtgttgcatgatggaacaaaaattgctgttaagaggatggaatctgttgcaatggggaacaaaggtcagaaagagttcgaagcagagattgcacttcttagtaaagttaggcatagacatttggttgctcttctagggtattgcatcaatggcaatgaaaggcttttggtgtatgagtatatgcctcaaggtacattaacacagcacctgtttgagtggcaggagcatgggtatgctcctttgacttggaagcaaagggtagtaatagctttggatgtagcgcggggggtggaatacttgcacagtttagctcagcaaagcttcattcatagagacttaaaaccctcaaacatactactaggcgatgacatgagagcaaaggttgctgattttgggttggttaaaaatgcaccagatgggaagtattctgttgagacacggttggctggaacatttggatatcttgcacctgagtatgcaggtacagaaagcctttgattttagttttgtacaattgtgccttaattttgaagttcatattttatatgctcgtatttggtggttatagctgttggttattacttcaatatcatgcttcggtgttcagcaaatttaagtagttcaccagagtaatcgctcacatacaaaaaaaaagtagaaagagttgaagggaaaataattgatactcaattcctagatacatggctacttcaaaattctttgtggctatttctttgcaatgttatattttgctcttttcacgtgttttgttgagttgggtgggggttttgctgcatagttcttggtggttgatgcctcaaaagatatgtcgagccatttttagacagtttaccagagtctgactctcaattatcctttacgatgtgatgaatactctggttgcattaaatctttgattgctgtatattgtcatgggcttaggtggtagttctctgtcgcaactaatcactgttgtggaatttatcattctatcccatttccttgttggatcggtgcattgaaacatcttttgttaaaactgttattttgatcggtgttgtttttatccatttagcatcaagacttttgcaagcataaaacttcctaaaatgttgcattgaatgtgattagatggcatttgattagtgctagtctatttgtttgattatatttaatgttactctgtttcttaccagctactggaagagtgacaaccaaagtggatgtttatgcatttggagtagttctgatggaacttatcaccggtagaaaggcattggatgatactgtgccagatgaaaggtctcacttggtgacatggttccgtagggtactaattaacaaggaaaacattccaaaggcaattgatcaaattctcaatccagatgaggaaaccatgggaagcatatatacagtggccgagctggcaggccattgcactgctcgcgaaccataccaaaggccggatatgggtcatgcagtgaacgtcttggttcctcttgtggagcaatggaaacctactagccatgatgaagaagaggaagacggctctggcggtgaccttcatatgagccttcctcaagctctacgaaggtggcaagccaacgaaggcacttcctcaatatttaatgacatttccatctcacaaacccaatcaagcatctcctctaaacctgcagggtttgcagactcctttgattcaatggattgccgttaacc

SEQ ID NO: 45 - DNA, 3480 bp, Glycine max; identical to SEQ ID NO: 44
  CDS (79)..(2242),(2958)..(3478): Clone ID: rhg4_Minsoy_amplicon

SEQ ID NO: 46 - DNA, 3480 bp, Glycine max
  CDS (79)..(2242),(2958)..(3478): Clone ID: rhg4_Jack_amplicon
atgtctctccccaaaaccctactttctctcttccttctcctcacgatccccctagtaaccgccgatgacgccgcggtgatgtcgaattttctcaaatccctcactccaccgccctcgggctggtctgaaacaaccccattctgccaatggaagggtatccaatgcgattcatccagccacgtgaccagcataagcctcgcttcgcagtccctcaccggaacactcccctcggatctcaattccctctctcaactccgcactctctccctccaagacaattccctcaccggcaccctcccttctctctccaacctttctttcctccaaaccgtctacttaaaccgcaacaacttctcctccgtgtcccccaccgctttcgcctccctaacctccctccaaaccctcagcctcggctccaaccctgctctccaaccctggtccttccccaccgacctcacttcctcctctaacctaatcgacctcgacctcgccaccgtatccctcaccggtcccttgccggacattttcgacaaattcccttcccttcaacaccttcgcctctcttacaacaacctcaccggcaatttaccctcctctttctccgccgccaacaatctcgaaacgctctggctcaacaaccaggccgccggcttgtccggtaccctcctcgtcctctccaacatgtctgcattaaaccagtcctggctcaataagaaccagttcaccggttccataccggatttatcgcaatgcacggctttgtctgacttgcagctcagggataaccagttaactggtgtggttcccgcttcattgacaagtcttcctagtttgaagaaagtttctctggataataatgagcttcaggggcctgtgcccgtgtttgggaaaggtgtgaatgttactctcgatgggattaatagtttttgtcttgatactcctgggaattgtgatcccagggtgatggttttgctgcagattgccgaggcattcgggtatccaattcggttggcagagtcgtggaaggggaatgatccgtgtgatggttggaactatgttgtgtgtgctgccggaaagattattactgtcaatttcgagaaacagggtttgcagggtaccatctcccctgcatttgccaatttgactgacttgaggactttgtttctcaatggcaataatttgatcggttctatacctgatagtttgatcactttgcctcagcttcagactcttgatgtgtctgacaacaacctctctggattggttcctaagttcccaccaaaggtgaagttggtgactgcgggaaatgctttgcttgggaaaccccttagtcctggaggtggaccaagtggaactactccttctgggtcttcgaccggtggaagtggtggtgaatcctcaaagggtaattcttcggtgtcgccaggttggattgctggtatagttgttattgtgttgttttttattgcagtggtgttgtttgtgtcttggaagtgttttgtcaacaagctgcaggggaagttcagtagggttaaaggtcatgaaaatgggaaaggaggctttaaacttgatgctgtccatgtttctaatggatatggtggtgttccagttgagttgcaaagccagagcagtggtgatcgcagtgaccttcatgctttagatggtccaacattttctatccaagttcttcgacaagtgacgaataatttcagcgaggagaacattttaggcaggggagggtttggagtagtttataagggggtgttgcatgatggaacaaaaattgctgttaagaggatggaatctgttgcaatggggaacaaaggtcagaaagagttcgaagcagagattgcacttcttagtaaagttaggcatagacatttggttgctcttctagggtattgcatcaatggcaatgaaaggcttttggtgtatgagtatatgcctcaaggtacattaacacagcacctgtttgagtggcaggagcatgggtatgctcctttgacttggaagcaaagggtagtaatagctttggatgtagcgcggggggtggaatacttgcacagtttagctcagcaaagcttcattcatagagacttaaaaccctcaaacatactactaggcgatgacatgagagcaaaggttgctgattttgggttggttaaaaatgcaccagatgggaagtattctgttgagacacggttggctggaacatttggatatcttgcacctgagtatgcaggtacagaaagcctttgattttagttttgtacaattgtgccttaattttgaagttcatattttatatgctcgtatttggtggttatagctgttggttattacttcaatatcatgcttcggtgttcagcaaatttaagtagttcaccagagtaatcgctcacatacaaaaaaaaagtagaaagagttgaagggaaaataattgatactcaattcctagatacatggctacttcaaaattctttgtggctatttctttgcaatgttatattttgctcttttcacgtgttttgttgagttgggtgggggttttgctgcatagttcttggtggttgatgcctcaaaagatatgtcgagccatttttagacagtttaccagagtctgactctcaattatcctttacgatgtgatgaatactctggttgcattaaatctttgattgctgtatattgtcatgggcttaggtggtagttctctgtcgcaactaatcactgttgtggaatttatcattctatcccatttccttgttggatcggtgcattgaaacatcttttgttaaaactgttattttgatcggtgttgtttttatccatttagcatcaagacttttgcaagcataaaacttcctaaaatgttgcattgaatgtgattagatggcatttgattagtgctagtctatttgtttgattatatttaatgttactctgtttcttaccagctactggaagagtgacaaccaaagtggatgtttatgcatttggagtagttctgatggaacttatcaccggtagaaaggcattggatgatactgtgccagatgaaaggtctcacttggtgacatggttccgtagggtactaattaacaaggaaaacattccaaaggcaattgatcaaattctcaatccagatgaggaaaccatgggaagcatatatacagtggccgagctggcaggccattgcactgctcgcgaaccataccaaaggccggatatgggtcatgcagtgaacgtcttggttcctcttgtggagcaatggaaacctactagccatgatgaagaagaggaagacggctctggcggtgaccttcatatgagccttcctcaagctctacgaaggtggcaagccaacgaaggcacttcctcaatatttaatgacatttccatctcacaaacccaatcaagcatctcctctaaacctgcagggtttgcagactcctttgattcaatggattgccgttaacc

SEQ ID NO: 47 - DNA, 3480 bp, Glycine max
  CDS (79)..(2242),(2958)..(3478): Clone ID: rhg4_peking_amplicon
atgtctctccccaaaaccctactttctctcttccttctcctcacgatccccctagtaaccgccgatgacgccgcggtgatgtcgaattttctcaaatccctcactccaccgccctcgggctggtctgaaacaaccccattctgccaatggaagggtatccaatgcgattcatccagccacgtgaccagcataagcctcgcttcgcagtccctcaccggaacactcccctcggatctcaattccctctctcaactccgcactctctccctccaagacaattccctcaccggcaccctcccttctctctccaacctttctttcctccaaaccgtctacttcaaccgcaacaacttctcctccgtgtcccccaccgccttcgcctccctaacctccctccaaaccctcagcctcggctccaaccctgctctccaaccctggtccttccccaccgacctcacttcctcctctaacctaatcgacctcgacctcgccaccgtatccctcaccggtcccttgccggacattttcgacaaattcccttcccttcaacaccttcgcctctcttacaacaacctcaccggcaatttaccctcctctttctccgccgccaacaatctcgaaacgctctggctcaacaaccaggccgccggcttgtccggtaccctcctcgtcctctccaacatgtctgcattaaaccagtcctggctcaataagaaccagttcaccggttccattccggatttatcgcaatgcacggctttgtctgacttgcagctcagggataaccagttaactggtgtggttcccgcttcattgacaagtcttcctagtttgaagaaagtttctctggataataatgagcttcaggggcctgtgcccgtgtttgggaaaggtgtgaatgttactctcgatgggattaatagtttttgtcttgatactcctgggaattgtgatcccagggtgatggttttgctgcagattgccgaggcattcgggtatccaattcggttggcagagtcgtggaaggggaatgatccgtgtgatggttggaactatgttgtgtgtgctgccggaaagattattactgtcaatttcgagaaacagggtttgcagggtaccatctcccctgcatttgccaatttgactgacttgaggactttgtttctcaatggcaataatttgatcggttctatacctgatagtttgatcactttgcctcagcttcagactcttgatgtgtctgacaacaacctctctggattggttcctaagttcccaccaaaggtgaagttggtgactgcgggaaatgctttgcttgggaaaccccttagtcctggaggtggaccaagtggaactactccttctgggtcttcgaccggtggaagtggtggtgaatcctcaaagggtaattcttcggtgtcgccaggttggattgctggtatagttgttattgtgttgttttttattgcagtggtgttgtttgtgtcttggaagtgttttgtcaacaagctgcaggggaagttcagtagggttaaaggtcatgaaaatgggaaaggaggctttaaacttgatgctgtccatgtttctaatggatatggtggtgttccagttgagttgcaaagccagagcagtggtgatcgcagtgaccttcatgctttagatggtccaacattttctatccaagttcttcgacaagtgacgaataatttcagcgaggagaacattttaggcaggggagggtttggagtagtttataagggggtgttgcatgatggaacaaaaattgctgttaagaggatggaatctgttgcaatggggaacaaaggtcagaaagagttcgaagcagagattgcacttcttagtaaagttaggcatagacatttggttgctcttctagggtattgcatcaatggcaatgaaaggcttttggtgtatgagtatatgcctcaaggtacattaacacagcacctgtttgagtggcaggagcatgggtatgctcctttgacttggaagcaaagggtagtaatagctttggatgtagcgcggggggtggaatacttgcacagtttagctcagcaaagcttcattcatagagacttaaaaccctcaaacatactactaggcgatgacatgagagcaaaggttgctgattttgggttggttaaaaatgcaccagatgggaagtattctgttgagacacggttggctggaacatttggatatcttgcacctgagtatgcaggtacagaaagcctttgattttagttttgtacaattgtgccttaattttgaagttcatattttatatgctcgtatttggtggttatagctgttggttagtacttcaatatcatgcttcggtgttcagcaaatttaagtagttcaccagagtaatcgctcacatacaaaaaaaaagtagaaagagttgaagggaaaataattgatactcaattcctagatacatggctacttcaaaattctttgtggctatttctttgcaatgttatattttgctcttttcacgtgttttgttgagttgggtgggggttttgctgcatagttcttggtggttgatgcctcaaaagatatgtcgagccatttttagacagtttaccagagtctgactctcaattatcctttacgatgtgatgaatactctggttgcattaaatctttgattgctgtatattgtcatgggcttaggtggtagttctctgtcgcaactaatcactgttgtggaatttatcattctatcccatttccttgttggatcggtgcattgaaacatcttttgttaaaactgttattttgatcggtgttgtttttatccatttagcatcaagacttttgcaagcataaaacttcctaaaatgttgcattgaatgtgattagatggcatttgattagtgctagtctatttgtttgattatatttaatgttactctgtttcttaccagctactggaagagtgacaaccaaagtggatgtttatgcatttggagtagttctgatggaacttatcaccggtagaaaggcattggatgatactgtgccagatgaaaggtctcacttggtgacatggttccgtagggtactaattaacaaggaaaacattccaaaggcaattgatcaaattctcaatccagatgaggaaaccatgggaagcatatatacagtggccgagctggcaggccattgcactgctcgcgaaccataccaaaggccggatatgggtcatgcagtgaacgtcttggttcctcttgtggagcaatggaaacctactagccatgatgaagaagaggaagacggctctggcggtgaccttcatatgagccttcctcaagctctacgaaggtggcaagccaacgaaggcacttcctcaatatttaatgacatttccatctcacaaacccaatcaagcatctcctctaaacctgcagggtttgcagactcctttgattcaatggattgccgttaacc

SEQ ID NO: 48 - DNA, 30 bp, Glycine max
  Clone ID: 318O13_region_A3_forward
atgtctctccccaaaaccctactttctctc

SEQ ID NO: 49 - DNA, 30 bp, Glycine max
  Clone ID: 318O13_region_A3_reverse
ggttaacggcaatccattgaatcaaaggag

SEQ ID NO: 50 - DNA, 2685 bp, Glycine max; identical to SEQ ID NO: 7
  Clone ID: rhg4_A3244_amplicon_cds

SEQ ID NO: 51 - DNA, 2685 bp, Glycine max; identical to SEQ ID NO: 7
  Clone ID: rhg4_Minsoy_amplicon_cds

SEQ ID NO: 52 - DNA, 2685 bp, Glycine max
  Clone ID: rhg4_Jack_amplicon_cds
atgtcgaattttctcaaatccctcactccaccgccctcgggctggtctgaaacaaccccattctgccaatggaagggtatccaatgcgattcatccagccacgtgaccagcataagcctcgcttcgcagtccctcaccggaacactcccctcggatctcaattccctctctcaactccgcactctctccctccaagacaattccctcaccggcaccctcccttctctctccaacctttctttcctccaaaccgtctacttaaaccgcaacaacttctcctccgtgtcccccaccgctttcgcctccctaacctccctccaaaccctcagcctcggctccaaccctgctctccaaccctggtccttccccaccgacctcacttcctcctctaacctaatcgacctcgacctcgccaccgtatccctcaccggtcccttgccggacattttcgacaaattcccttcccttcaacaccttcgcctctcttacaacaacctcaccggcaatttaccctcctctttctccgccgccaacaatctcgaaacgctctggctcaacaaccaggccgccggcttgtccggtaccctcctcgtcctctccaacatgtctgcattaaaccagtcctggctcaataagaaccagttcaccggttccataccggatttatcgcaatgcacggctttgtctgacttgcagctcagggataaccagttaactggtgtggttcccgcttcattgacaagtcttcctagtttgaagaaagtttctctggataataatgagcttcaggggcctgtgcccgtgtttgggaaaggtgtgaatgttactctcgatgggattaatagtttttgtcttgatactcctgggaattgtgatcccagggtgatggttttgctgcagattgccgaggcattcgggtatccaattcggttggcagagtcgtggaaggggaatgatccgtgtgatggttggaactatgttgtgtgtgctgccggaaagattattactgtcaatttcgagaaacagggtttgcagggtaccatctcccctgcatttgccaatttgactgacttgaggactttgtttctcaatggcaataatttgatcggttctatacctgatagtttgatcactttgcctcagcttcagactcttgatgtgtctgacaacaacctctctggattggttcctaagttcccaccaaaggtgaagttggtgactgcgggaaatgctttgcttgggaaaccccttagtcctggaggtggaccaagtggaactactccttctgggtcttcgaccggtggaagtggtggtgaatcctcaaagggtaattcttcggtgtcgccaggttggattgctggtatagttgttattgtgttgttttttattgcagtggtgttgtttgtgtcttggaagtgttttgtcaacaagctgcaggggaagttcagtagggttaaaggtcatgaaaatgggaaaggaggctttaaacttgatgctgtccatgtttctaatggatatggtggtgttccagttgagttgcaaagccagagcagtggtgatcgcagtgaccttcatgctttagatggtccaacattttctatccaagttcttcgacaagtgacgaataatttcagcgaggagaacattttaggcaggggagggtttggagtagtttataagggggtgttgcatgatggaacaaaaattgctgttaagaggatggaatctgttgcaatggggaacaaaggtcagaaagagttcgaagcagagattgcacttcttagtaaagttaggcatagacatttggttgctcttctagggtattgcatcaatggcaatgaaaggcttttggtgtatgagtatatgcctcaaggtacattaacacagcacctgtttgagtggcaggagcatgggtatgctcctttgacttggaagcaaagggtagtaatagctttggatgtagcgcggggggtggaatacttgcacagtttagctcagcaaagcttcattcatagagacttaaaaccctcaaacatactactaggcgatgacatgagagcaaaggttgctgattttgggttggttaaaaatgcaccagatgggaagtattctgttgagacacggttggctggaacatttggatatcttgcacctgagtatgcagctactggaagagtgacaaccaaagtggatgtttatgcatttggagtagttctgatggaacttatcaccggtagaaaggcattggatgatactgtgccagatgaaaggtctcacttggtgacatggttccgtagggtactaattaacaaggaaaacattccaaaggcaattgatcaaattctcaatccagatgaggaaaccatgggaagcatatatacagtggccgagctggcaggccattgcactgctcgcgaaccataccaaaggccggatatgggtcatgcagtgaacgtcttggttcctcttgtggagcaatggaaacctactagccatgatgaagaagaggaagacggctctggcggtgaccttcatatgagccttcctcaagctctacgaaggtggcaagccaacgaaggcacttcctcaatatttaatgacatttccatctcacaaacccaatcaagcatctcctctaaacctgcagggtttgcagactcctttgattcaatggattgccgttaa

SEQ ID NO: 53 - DNA, 2685 bp, Glycine max
  Clone ID: rhg4_peking_amplicon_cds
atgtcgaattttctcaaatccctcactccaccgccctcgggctggtctgaaacaaccccattctgccaatggaagggtatccaatgcgattcatccagccacgtgaccagcataagcctcgcttcgcagtccctcaccggaacactcccctcggatctcaattccctctctcaactccgcactctctccctccaagacaattccctcaccggcaccctcccttctctctccaacctttctttcctccaaaccgtctacttcaaccgcaacaacttctcctccgtgtcccccaccgccttcgcctccctaacctccctccaaaccctcagcctcggctccaaccctgctctccaaccctggtccttccccaccgacctcacttcctcctctaacctaatcgacctcgacctcgccaccgtatccctcaccggtcccttgccggacattttcgacaaattcccttcccttcaacaccttcgcctctcttacaacaacctcaccggcaatttaccctcctctttctccgccgccaacaatctcgaaacgctctggctcaacaaccaggccgccggcttgtccggtaccctcctcgtcctctccaacatgtctgcattaaaccagtcctggctcaataagaaccagttcaccggttccattccggatttatcgcaatgcacggctttgtctgacttgcagctcagggataaccagttaactggtgtggttcccgcttcattgacaagtcttcctagtttgaagaaagtttctctggataataatgagcttcaggggcctgtgcccgtgtttgggaaaggtgtgaatgttactctcgatgggattaatagtttttgtcttgatactcctgggaattgtgatcccagggtgatggttttgctgcagattgccgaggcattcgggtatccaattcggttggcagagtcgtggaaggggaatgatccgtgtgatggttggaactatgttgtgtgtgctgccggaaagattattactgtcaatttcgagaaacagggtttgcagggtaccatctcccctgcatttgccaatttgactgacttgaggactttgtttctcaatggcaataatttgatcggttctatacctgatagtttgatcactttgcctcagcttcagactcttgatgtgtctgacaacaacctctctggattggttcctaagttcccaccaaaggtgaagttggtgactgcgggaaatgctttgcttgggaaaccccttagtcctggaggtggaccaagtggaactactccttctgggtcttcgaccggtggaagtggtggtgaatcctcaaagggtaattcttcggtgtcgccaggttggattgctggtatagttgttattgtgttgttttttattgcagtggtgttgtttgtgtcttggaagtgttttgtcaacaagctgcaggggaagttcagtagggttaaaggtcatgaaaatgggaaaggaggctttaaacttgatgctgtccatgtttctaatggatatggtggtgttccagttgagttgcaaagccagagcagtggtgatcgcagtgaccttcatgctttagatggtccaacattttctatccaagttcttcgacaagtgacgaataatttcagcgaggagaacattttaggcaggggagggtttggagtagtttataagggggtgttgcatgatggaacaaaaattgctgttaagaggatggaatctgttgcaatggggaacaaaggtcagaaagagttcgaagcagagattgcacttcttagtaaagttaggcatagacatttggttgctcttctagggtattgcatcaatggcaatgaaaggcttttggtgtatgagtatatgcctcaaggtacattaacacagcacctgtttgagtggcaggagcatgggtatgctcctttgacttggaagcaaagggtagtaatagctttggatgtagcgcggggggtggaatacttgcacagtttagctcagcaaagcttcattcatagagacttaaaaccctcaaacatactactaggcgatgacatgagagcaaaggttgctgattttgggttggttaaaaatgcaccagatgggaagtattctgttgagacacggttggctggaacatttggatatcttgcacctgagtatgcagctactggaagagtgacaaccaaagtggatgtttatgcatttggagtagttctgatggaacttatcaccggtagaaaggcattggatgatactgtgccagatgaaaggtctcacttggtgacatggttccgtagggtactaattaacaaggaaaacattccaaaggcaattgatcaaattctcaatccagatgaggaaaccatgggaagcatatatacagtggccgagctggcaggccattgcactgctcgcgaaccataccaaaggccggatatgggtcatgcagtgaacgtcttggttcctcttgtggagcaatggaaacctactagccatgatgaagaagaggaagacggctctggcggtgaccttcatatgagccttcctcaagctctacgaaggtggcaagccaacgaaggcacttcctcaatatttaatgacatttccatctcacaaacccaatcaagcatctcctctaaacctgcagggtttgcagactcctttgattcaatggattgccgttaa

SEQ ID NO: 54 - DNA, 120 bp, Glycine max
  Clone ID: 240O17_region_G3__289711_11
aaaccttgacgttgttgtctttgttttcattaataaaaaaatcatataaggtccaccttatcccacgacacaacatatatatatacttccttaattaccgggtgattggtacaatattcc

SEQ ID NO: 55 - DNA, 128 bp, Glycine max
  Clone ID: 240O17_region_G3__236585_14
agtccgggagattagttgcagtaaaaaagtccgggtgattagagttaaagaatatatgtaaagatatcttaataaaaacaaaacaaaaaacaaaaaagttagatcaggcaatcagattcagatcttca

SEQ ID NO: 56 - DNA, 129 bp, Glycine max
  Clone ID: 240O17_region_G3__168772_13
tttgcattgtttcaatttatttccatggtttgtctattaataaactgggtcaacctcttaaccccatgatgattatatatacgttttgcgtgtgtgtgtgtgatcactcaatgtctgttggttgaaatt

SEQ ID NO: 57 - DNA, 131 bp, Glycine max
  Clone ID: 240O17_region_G3__332420_21
gagaatctgcaactgaaccaaatgattaaactaaaaaaacaagctagaaaagaaaagtaaagaaaaaaagagattgttttactagtcccctcctatgtagttgaaaccagtctgctgttccattcctaagt

SEQ ID NO: 58 - DNA, 135 bp, Glycine max
  Clone ID: 240O17_region_G3__228126_18
atagctctgttgcaaaggaagatggtggagcttcaacatgatctggcaattgcaaaggatcgtcttgcgcgttgtcacgctgctgctgctgctgctactactactatcccttctcctgatatcttgcatgccaat

SEQ ID NO: 59 - DNA, 137 bp, Glycine max
  Clone ID: 240O17_region_G3__139723_11
ttgcattcaaattcatggaactaccattttttcctagcctcccccttcaggatacatcacacacacaccgtgaaagttaaaaagttaaaaggttagaatttttgacatagcagttatgtttcatgcacacatggtga

SEQ ID NO: 60 - DNA, 138 bp, Glycine max
  Clone ID: 240O17_region_G3__280585_14
tttacaagtgcatcatttaacttctcatatattatatataaaaagaggggtaaaaggaaatttatcttatcttattgatcataatttctcatatattaaatcaaacgctacgtacaggatctttaaattgaggccaaa

SEQ ID NO: 61 - DNA, 139 bp, Glycine max
  Clone ID: 240O17_region_G3__70509_14
cctatgaagaatacacccacgttgaaatacatgttgttgttgttggacgcgcccagccgagagtgccggtccacgagtatccccaacgtgcatggcgcatgcgcttgaaacctagtattcatcttcctgatggaggctg

SEQ ID NO: 62 - DNA, 139 bp, Glycine max
  Clone ID: 240O17_region_G3__50537_17
aaacccaacataattccaacttcaaaattcactcaataaaaagtttaacatgtaaatttacttggaaacaaaactcataaccaataataataataataaaagaaatcagttttatagcattaatttgggatgctctgct

SEQ ID NO: 63 - DNA, 139 bp, Glycine max
  Clone ID: 240O17_region_G3__231556_17
agcccttccacaaactagagcgtatgaagtgaaatatcgtcaaacttttcatatctgccaatgctctcaattattttaaatttcattcaagaagaagaagaagaaatacttcacatttactggaagtgtttcggcagaa

SEQ ID NO: 64 - DNA, 141 bp, Glycine max
  Clone ID: 240O17_region_G3__117057_11
aaagacggaacagcgtcaaataaacggggagagagagagggttaagggcagatcaggaagagacccatcttcgctgaggatgccgtgagggaagttgcgaatgggagaagagagggtgtaattgtagagcgtgtttccgtc

SEQ ID NO: 65 - DNA, 142 bp, Glycine max
  Clone ID: 240O17_region_G3__23092_13
tcaataggtactggcacaagacacctagtaatatgcgaaatctcttatgtttgtatcaccaaaatggacaatgagaggacataacaacaacaacaccaccaaaaccttatcccactaggaatgagaggacataaagggctaa

SEQ ID NO: 66 - DNA, 144 bp, Glycine max
  Clone ID: 240O17_region_G3__297741_14
tttataaatctgtccagccaccaaaataatgttccaggtgtcaaaaactatgctctaacctttttattttattttttattttgcattttgaaaaaacagactctgttttgctttttcgaagcacgggcataccaatctagttct

SEQ ID NO: 67 - DNA, 145 bp, Glycine max
  Clone ID: 240O17_region_G3__206502_14
agaagaagacgacgacatcgaagagccagaagacgaagacgaagaagaggaggaggaggacgacgacgacgacgacgtcgtttcgcaggagcaatccccattgtcgcggctgcgcgagcagcgttcgaagctggaaaccctgtcc

SEQ ID NO: 68 - DNA, 145 bp, Glycine max
  Clone ID: 240O17_region_G3__221223_13
ccagagtcttgtaagaaagccatcaattactgtcagttatacagcctaaaaaataagtaaaataaaattactcttgtaacatgcgaggaagagagagagagattggcgccaaagtttgttagaaagaatggacatgtgtcagctg

SEQ ID NO: 69 - DNA, 146 bp, Glycine max
  Clone ID: 240O17_region_G3__169084_14
tttgcttgaataaatgtgcacagaattacatatttttgttttgttttttctactaacaagtagtgactagtgagagagagtgcttatagatgttctcttttgacaatgtacagagttaaaaaaaattcagaaggagcaacctttgc

SEQ ID NO: 70 - DNA, 292 bp, Glycine max
  Clone ID: 240O17_region_G3__94891_14
catcaacaaatcacacacacacacaaacacaaagtgatatatatctccggagagaagaagaaacaaagagattcatttttagttactattatttttattataaattaaataataataataacaatgccttcttctcttcagttggaggtgctgtagtgcttgaaacagttgcatcgtttggccttatgttcttcttcttcatatggtgtgttaaaatggatgttgccacattgatgaagactgaaaagctggccatcactgttggtatttctgtgttcgcatttacattggt

SEQ ID NO: 71 - DNA, 147 bp, Glycine max
  Clone ID: 240O17_region_G3__281852_61
aaccagaggaaacagggagtcatttcagataacataatgcagttcatatttaccaatatatatatatatatatatatatatatatatatatatatatatatatatatatatatataccacaaacgacggaggattaatgaaagactg

SEQ ID NO: 72 - DNA, 147 bp, Glycine max
  Clone ID: 240O17_region_G3__46583_12
gtaacaaattctgaaccctgcatgttcattctctctctctcacgctcgcaacccgcgcgcgcacctacacttcttttatgtcatcacgtgctccttctcactctccctctctctcactacaaaaaccattcttcaacttgcaacaca

SEQ ID NO: 73 - DNA, 148 bp, Glycine max
  Clone ID: 240O17_region_G3__306835_13
agtctcccagatgatcaattctgctcataggcttttattgcttgcattctatgtccatttcaaatagtaagtcactatatatgacgtgtttggtttcacgtctttacagcgtgcgtgcgtgtttagtttcacgtcttggatgtgattt

SEQ ID NO: 74 - DNA, 149 bp, Glycine max
  Clone ID: 240O17_region_G3__85471_12
cgtggccacttgatctataagagagttctaattgaccaattaattagtgaaaacatataaaaaggaaaggaaacatttgtttccttaagaatgaagaaaccaaaaagaagtaaagaagaagaagcaagggaaagcaaagaagctaatat

SEQ ID NO: 75 - DNA, 150 bp, Glycine max
  Clone ID: 240O17_region_G3__257208_12
ccatgaatgaaactcaccaaactgaagagaggcagagtcagtgacatgatgagggagtatttgtataggcactgcaaaggaagaagaagaatgatcactgcattgagcccagctgctgttgcccatgtgccagccagaatcatagtaatt

SEQ ID NO: 76 - DNA, 150 bp, Glycine max
  Clone ID: 240O17_region_G3__150390_17
ttacgcactcagatttggatttgattactactgcattaatatataaataattaattaattgcttgcatgcatgcatgcatttgtattaactagggctggatagctagcttaggcggcctctactatcatggtgattaaacttcacaccct

SEQ ID NO: 77 - DNA, 150 bp, Glycine max
  Clone ID: 240O17_region_G3__34697_75
gcatgctcttaggtgattgcagagcatcctttggttatatatatatatatatatatatatatatatatatatatatatatatatatatatatatatatatatatatatatttgtagaaacatgaaggatacattcaactgccttcatgaa

SEQ ID NO: 78 - DNA, 150 bp, Glycine max; identical to SEQ ID NO: 76
  Clone ID: 240O17_region_G3__150374_13

SEQ ID NO: 79 - DNA, 151 bp, Glycine max
  Clone ID: 240O17_region_G3__40513_22
attctgaaattggtggaaggttctgaatccagcaaaacacatcaagaaagttgttagccatggatcgaatgaagcaacttaattaatataactctctctctctctatctctctaattcggttgcattcaggtgtggcttcacatttatttg

SEQ ID NO: 80 - DNA, 151 bp, Glycine max
  Clone ID: 240O17_region_G3__268602_14
aacacgtctcatctcaagaagctcatgcttttcaatctgcattccagataataataataatctatcggtttcctataattaactgaaaaatagtcaacatgaagaatgaatgcagccaaccttctgtgctaggcctatttggtcgaagtta

SEQ ID NO: 81 - DNA, 152 bp, Glycine max
  Clone ID: 240O17_region_G3__25357_13
acttctcccacactttccctttctctttccctatcgccaacggttctcctatcaccgtcgcgtcgtaaatcctcgaagttatcacttcctcctcctccttcttcttcggcggctcctccggcttcggcgccgaagccagaggagattccgct

SEQ ID NO: 82 - DNA, 152 bp, Glycine max
  Clone ID: 240O17_region_G3__137548_13
gtatgaaccctaaagctggcttcgagggcagcaaacctccagcaagaagaagaagacacagaggtaagaaaagggaaatatcattttctcattcatccccttgcttgttatttacatggatatatatagcattcctcttaacaaatctgtgc

SEQ ID NO: 83 - DNA, 152 bp, Glycine max; identical to SEQ ID NO: 82
  Clone ID: 240O17_region_G3__139131_13

SEQ ID NO: 84 - DNA, 153 bp, Glycine max
  Clone ID: 240O17_region_G3__203855_12
ttgttgtcaagagaagggaagctctttaaagacagaggcctcctggaagcttttgcttcctgatgctgcaggagattccttctaaattagctaactgaataccactaacaacaacaacgagatgcctaaaacaacacagatgtgagcacatga

SEQ ID NO: 85 - DNA, 153 bp, Glycine max
  Clone ID: 240O17_region_G3__199049_15
ggcaaatcacatgtacataagggagataaaagaatgcgattttttcttttcttttcctgcggtgcttcgtttggttatggtttatgaaattatactaacaaaaaaaagtttcacatcagttaatttcatttgctcagtgagtttatttggtga

SEQ ID NO: 86 - DNA, 154 bp, Glycine max
  Clone ID: 240O17_region_G3__320907_12
gattcgccggaaattctctcctccgccgccgccgtcctcgtcaccaccgccgaaaaagaaggggaaccttcgcggcggctcggataagttgcagaggaaaatcggcgggccgcgggggcggagagggcggaggatggcgagcttaatatcggag

SEQ ID NO: 87 - DNA, 154 bp, Glycine max
  Clone ID: 240O17_region_G3__16407_17
cacactctcacagcaacttctcgatctgattactctgaactttgtctccaaatgggcatccattttttcaggtaagtcaaaccaaaccaaaccatgcataaatacatacacacttgcaccattttgctggaaatcccacgtggatcagtgatat

SEQ ID NO: 88 - DNA, 154 bp, Glycine max
  Clone ID: 240O17_region_G3__206516_17
cagaagacgaagacgaagaagaggaggaggaggacgacgacgacgacgacgtcgtttcgcaggagcaatccccattgtcgcggctgcgcgagcagcgttcgaagctggaaaccctgtcccggcgattggcgtcggagctggtcccaatccgagt

SEQ ID NO: 89 - DNA, 155 bp, Glycine max
  Clone ID: 240O17_region_G3__264495_13
agtggcataaagcaagaagttcaccaaacgaatattttttattctacagaaaaaaattactattactaatactattattattatttgactccattaaagacccgagtcaaataattcctaccatctaaaattcagtatgcattcccttgaatctc

SEQ ID NO: 90 - DNA, 156 bp, Glycine max
  Clone ID: 240O17_region_G3__156785_13
atctagtgcctccacgcatctctaccctcaaatcttcaccacacaacactacctcaattactcaactaaagcttcattcattcatcgtgtcgtgttgtgttctttgcaaccatgcttcttagaacagcgtcctctttctctctcttcaacgccaac

SEQ ID NO: 91 - DNA, 156 bp, Glycine max
  Clone ID: 240O17_region_G3__187129_12
tgattgggaaggaaagcttcattagatgtgataagttaaataatttaattgagattagttgtaataataataaaaatctttagaaatgcagcttgtgatttggaggttgtgatggatgagtttcggtaccgggtttggtcatggtgcaagataaat

SEQ ID NO: 92 - DNA, 156 bp, Glycine max
  Clone ID: 240O17_region_G3__214106_13
ccatcttcttctcaatcctcatgttgccacgtgtctcgaatctccaccgagaccttggaggtctcgccgccgccgcctcccgacttcaacttccgccgcgaaatcgcgcgcctcgccgacctccgcgacaggctctccgcgtgctctactttaaac

SEQ ID NO: 93 - DNA, 156 bp, Glycine max
  Clone ID: 240O17_region_G3__149013_12
aagctcaacgtggatgtttgttagacatacaattacaaacactcacgtgaatacacacgttaacattactttctctttctgtagttgtgcgcatactttgactcaattcaacaattatatatatataaatcaaagcgaaataaatgtctagtgtgc

SEQ ID NO: 94 - DNA, 157 bp, Glycine max
  Clone ID: 240O17_region_G3__326352_16
gttgttaccttgtgtgttcgctttgccaacgttttcaattacttttcttttcttttccttttttttaaatcactccaaataccaaacaccctctccaattttgggacctcccctccataatacaattatagtgatatgaacttgcttccacaaccct

SEQ ID NO: 95 - DNA, 157 bp, Glycine max
  Clone ID: 240O17_region_G3__278962_12
tcgaatctatcgcggaatactcaattcgggagagagagagaaaaaaaacagaatctagtaaagcatgatagttattattctactgctacttatcacaagatagcaggttttgttgtagttaagtagcgaagtggagttgcaaattgagctaaggaaa

SEQ ID NO: 96 - DNA, 157 bp, Glycine max
  Clone ID: 240O17_region_G3__256930_13
tgtgacctatctttcctccgttctcccttcatccttttccaaccattaagtcaaccttatatcttcctggataatactactatgtatgtatgtcactcatgaaaactgaaaaagagactcgtgcaataaaaattggtttaccttatcagacttggga

SEQ ID NO: 97 - DNA, 158 bp, Glycine max
  Clone ID: 240O17_region_G3__29646_14
acgcaactcagatgcattaacacaaatatacacacacacacaaataaatagagagagacatacatacatactttaaataaatgcacagtatttattaagagacattgattatcttacactaatacataactatatcagtggacgatgatcattattca

SEQ ID NO: 98 - DNA, 158 bp, Glycine max; identical to SEQ ID NO: 97
  Clone ID: 240O17_region_G3__29618_13

SEQ ID NO: 99 - DNA, 158 bp, Glycine max
  Clone ID: 240O17_region_G3__108561_14
aatgttgcttgccttcacagctaagcgagcgaggaagattgagaataataataataactttccctgttcaaataggatatacattacatcaaataaacaaaaaggtgtcaacaaatatacgtggctatttttctctgggttatgaataagggtttgga

SEQ ID NO: 100 - DNA, 158 bp, Glycine max
  Clone ID: 240O17_region_G3__143975_14
cggtagctatagcgtattgcaacaaagggggtgatcatgaaatgaaatgatgcatgtagcaattgtttggtccttgccttttttggatgacctcggatagaagagaaaacgatcgatatatggttatgacctgtgaatgtgatactactgacgatggg

SEQ ID NO: 101 - DNA, 159 bp, Glycine max
  Clone ID: 240O17_region_G3__108431_20
ccgaatgacagagaggaagaagaaaaaaattaatgatgaaaataatatttgtctttgcagttttattagtattattatttttattattaagaagtagtatatttccaaggttgaaatgtttttgagcctttgagggtcagtggtgtgggaagttgaaat

SEQ ID NO: 102 - DNA, 159 bp, Glycine max
  Clone ID: 240O17_region_G3__281764_11
ttcctggtgagtaacaagtgtagggaactttcctgcaaggttttcacaacataacaaaattaactaaagttacaagaaagaaacacactataaaaattctttcaaacaaagcaatccactatatatatattccgtcgtttgaatagagcatgaaccaga

SEQ ID NO: 103 - DNA, 160 bp, Glycine max
  Clone ID: 240O17_region_G3__130058_15
agtctcgctcctatttcgagtcctttcactaccctttcaacaaagcttcttcttcggtcaacaattcttcttcttcttcgttgcccaacaggcgcagattgcttgtgtgccatgacatggctgggggctacttggatgataagtggattcaaggtggcac

SEQ ID NO: 104 - DNA, 160 bp, Glycine max
  Clone ID: 240O17_region_G3__310590_52
ttccctaataatggtggaagcagttattatgtgatgtggttaacctttcattattattatatatatatatatatatatatatatatatatatatatatatatatatatacctttcattttctttaaaataatgtcgtagaacaccatattgggtttgggt

SEQ ID NO: 105 - DNA, 161 bp, Glycine max
  Clone ID: 240O17_region_G3__313405_14
cggatgttaaatgattggttcgtttttcagtatcaattgacttgatgtttatttatgttattatttatttatttgttgttaattattgactaattttcatgataatagcaaaatgtccgtacataatttagagaaatttccagaaccagtccaacataatt

SEQ ID NO: 106 - DNA, 161 bp, Glycine max
  Clone ID: 240O17_region_G3__302190_13
ttaacccactaccaaatatactccaaaaggaaagcgaacatgtttttaatttcattctcttaattaaaatggtaaagacatgaaatcaaatcatgccaataaataaataaggtaactagaaataatttatcccctgatcgtgttcatcctaaccgaacttg

SEQ ID NO: 107 - DNA, 161 bp, Glycine max
  Clone ID: 240O17_region_G3__225343_17
cccgcaatttgttatagtgggaaaaaataataaaataaaataaaacgaactaggcagttgaattaaacaagtggactctttccaatgtagagttggaggctgcattatcttctttgatacccttttcaatcttccaccatgcgtttgaagtgacatttact

SEQ ID NO: 108 - DNA, 162 bp, Glycine max
  Clone ID: 240O17_region_G3__208823_14
tactttccaaattgatgcagaccagaaattttaaatgaatttatcgttataactatatatttgtaattaattaattattgtggttactttaatttggaggatttgattgtgtatagatttttattcccaaatttatttccttgtaactccctatttgggaca

SEQ ID NO: 109 - DNA, 163 bp, Glycine max
  Clone ID: 240O17_region_G3__74285_11
tgatgacaatgatgacgatttgtgataattgttgcaaaaaaagtgaaaagaaaataaggggttaaagagagagagaaaattgtagcctttcaatatttttttaaatttattaaaagggaaaaaaacttttatagctagcttaccaggacgttgcagatgaatt

SEQ ID NO: 110 - DNA, 163 bp, Glycine max
  Clone ID: 240O17_region_G3__109052_16
cacatttgatgattgattccagttttgcacatacaatgcatacattactttttttattattattattatatgctcggtctaatttggattcggggaagtagtacatgtttgtttgagctcgcacaaaatatattttattagccagaaagcactgacattatgg

SEQ ID NO: 111 - DNA, 163 bp, Glycine max
  Clone ID: 240O17_region_G3__6395_12
tactactgaaccgtggtgcctgatagcaaaaaaattatttttttgtgacggtcttatccttgagtcgtccctgtaatctagctaaagtaaatgttgcgtgcgttcgctattatatatatataattgacaatattaaccattaaccacaatgcatttgtatggc

SEQ ID NO: 112 - DNA, 164 bp, Glycine max
  Clone ID: 240O17_region_G3__244905_16
tgaaatccaagtgaaagattgttaaaaattttataatttctaattaattaattaatgtgacttacatattatattataacatatagtttacattaattaattaagaattacaaaattcataacattaatgtctcaatccatggacgttggaggtaatacgcata

SEQ ID NO: 113 - DNA, 164 bp, Glycine max; identical to SEQ ID NO: 112
  Clone ID: 240O17_region_G3__244956_13

SEQ ID NO: 114 - DNA, 165 bp, Glycine max
  Clone ID: 240O17_region_G3__117220_13
aagagaattggcaaagtgcagtagcggtggcgaaggttaggtgttgaagaagaagaagcgtgaagaaagtgacgatgatgatgcgttgagccaccattgtcgtcattgtttgaagggtgaaaacgcacgcctattatttcatgctgagagtgaagaagatgggag

SEQ ID NO: 115 - DNA, 166 bp, Glycine max
  Clone ID: 240O17_region_G3__134707_14
tgtacatcaaactggcaaggaagaggtgaacaacacaaaatctagctctgaacccccatcgaagaaataattttctgcaggataacttaaaagcctaaacaagaccctagcaatcttcttcaaaaataaataaataaccttaacaatttcccttctgtgcaatctc

SEQ ID NO: 116 - DNA, 168 bp, Glycine max
  Clone ID: 240O17_region_G3__35078_13
agcaagatcagaagtcgcaaacacacgagcagagatggcagtcggcaaagcacgttcataacaaaaaaaaaatgcaggtagagatgaggagagagagagagttacagtgaaaggaacgaatggcaggcgaggattccatgggaagaaatggaaatggaagaatgggag

SEQ ID NO: 117 - DNA, 168 bp, Glycine max
  Clone ID: 240O17_region_G3__210506_16
ttgatattgttgcaaatcacctgaatataatttatttatttattttactctttcaactatgtactgataataatataatttagagaaacaaccagttgtggttgtaaggttggcaatgtttgacaaaattatccaatctcttttctgatgtggcacttacttgacctc

SEQ ID NO: 118 - DNA, 169 bp, Glycine max
  Clone ID: 240O17_region_G3__116961_26
atccgggaaatgattctaaacatgaatcaaggaagactgaaatatgaaaattcaattaataaaacaaattacagaaatatatatatatatatatatatatatcctaacaatcaaaaggttatggaaaacagagaaacaagaagaaaagacggaacagcgtcaaataaac

SEQ ID NO: 119 - DNA, 169 bp, Glycine max
  Clone ID: 240O17_region_G3__51073_13
caaattgccacatttctcatgtcagttactcgtattctcccataaataaataaggcttcttctgtctcaatttattttacttctaaagcaacaatttctttctttctcattttttttgtaccctctgatcagatcgtagtccgatcctcaagccttagcctctacacac

SEQ ID NO: 120 - DNA, 170 bp, Glycine max
  Clone ID: 240O17_region_G3__55291_15
ccctagggacaacagggtacctaattaattggtaccacaacggggagaaaatcaacacgtttgtggaatatacatacctagaattgaagggctagctcaatcaagctaaacttgaattcaactatagaaattaaattaaattgaaatttggttacacgagtcaggaccat

SEQ ID NO: 121 - DNA, 170 bp, Glycine max
  Clone ID: 240O17_region_G3__229651_18
acaatcaaggaatctaagccacacattctttaacatttattattattattattaagtgaaatttatgtttaagtgttactaaatgatgtgactgtaaatgttccactctatttagtaggtctcacagtttcacctaatgataaagagtgccaacattactgcaagaacag

SEQ ID NO: 122 - DNA, 171 bp, Glycine max
  Clone ID: 240O17_region_G3__303308_19
caactcctctttcaattcgcacacacccaacccaacccaaccctttaaatcaaaaccaaaaacttgtttccatttcatacttcattatatatgtatatatacatacatatacacgaattgaagctagcctatctagtatatatcttacccttagacacaacaaattccaca

SEQ ID NO: 123 - DNA, 171 bp, Glycine max
  Clone ID: 240O17_region_G3__168373_20
gaacaggctatcatggctgaagaaggtaggttagttttgtactttttaagtgtgtactatatatatgtcttacatgccatatcctgttagtgaaacttgtattatgtgtgttgtgtgtgtgtgtgtgtgtgcttgtgtgtgcttacacacaagcattcagcatcatctgat

SEQ ID NO: 124 - DNA, 172 bp, Glycine max
  Clone ID: 240O17_region_G3__253333_17
gtcatcacccatataaacttgtccaataacacttgatgtgtactaaatttttactaggtgttttaagtcttagtatggttaggttaggttaggcttgcaggacaaaacttctatttcatcatgtattgatttcatgatttctagacgattgatgttgatggaagcgaatctt

SEQ ID NO: 125 - DNA, 172 bp, Glycine max
  Clone ID: 240O17_region_G3__5791_13
aaagagagattagggaaccattggatgattgattgattatgcagttctttagctgttctgaagtttcatttcactaacctatgtatccttacatttaatgtaacttttattatgtaattttgttgacagattttataatgtaaattactgacacgaaatttctatttggatt

SEQ ID NO: 126 - DNA, 173 bp, Glycine max
  Clone ID: 240O17_region_G3__206841_19
agctgcctcacaccgccaatgtcgtcgtcgacgtcgtcgagtccgccaacagaatctccggcgatttcggcgtttacaccaaacccgcggtacaattttgctctctagtgtgtgttatgttgagattgcactagattgaattcattccaagtgagggaccgagagatgctagt

SEQ ID NO: 127 - DNA, 175 bp, Glycine max
  Clone ID: 240O17_region_G3__202827_12
agttggctcaaacaaatcagattccttggactttcctagcaattttggtggtggtggaggtggaacttcttgttcctggagctcatcatcagcaaggattgaaaacccaccaatgtcatttcccctaatgctctggtgggccttctcctgcttggtggtggttcttctcctaaca

SEQ ID NO: 128 - DNA, 177 bp, Glycine max
  Clone ID: 240O17_region_G3__322656_13
tgtcccaatatcctaggtagagccatataatatcaacagtaaattacttcctatattttcaacacacttacatttttagcaactataaataaataaaattatctaattatgttagaataatctcttattatagtcaatttgtgttctcaatgatgacaagtgaatgtgatcaaaccg

SEQ ID NO: 129 - DNA, 178 bp, Glycine max
  Clone ID: 240O17_region_G3__111841_14
tgctttagctcagtaacctgcttgagaaaattacaacagtaaataatagttgtctttggttttaaattcatatcaccttcatattgctctttgttttcaactttttccaagtcattgttcgtattcttggaggagagagagagagaatgataggatgccagcaagataaactaacatg

SEQ ID NO: 130 - DNA, 179 bp, Glycine max
  Clone ID: 240O17_region_G3__192719_13
gctacttcttggcaagctctattcgaatcgaccatgaagtcttttaccaagtcttgagagagacttgatatattatatatcatcatttagtctcgccatgggtgcatgataggctccaaaactcgctatttcatcatcatcattttatacgaaaacattgaccctaaaggcacaacaac

SEQ ID NO: 131 - DNA, 183 bp, Glycine max
  Clone ID: 240O17_region_G3__195630_17
ttggagttgagtgttctgatggaagagtagtggtcttgtaagttctgattttgtgatgtttttcagaaactgaatatatgtagatttctgttcaatttaatttatgtccagaggcagaacaaaaaaatgaatgttttttcttcttttcttttctttttttcattagggtcatcgtacgagaga

SEQ ID NO: 132 - DNA, 183 bp, Glycine max
  Clone ID: 240O17_region_G3__69999_13
tttccacaaagactcctgcccttttctatcagctaaaattatttatgtacaaataaaaaaggtacaaacacaacatttatttatgaacagataaacgtttttgtgagacattaactgaacctactctatcaagcttattattactactactacttatcttcactccaccacactgtgtcacta

SEQ ID NO: 133 - DNA, 184 bp, Glycine max
  Clone ID: 240O17_region_G3__11176_13
cgttctcgtcgaataataccgattcgacaaataaaaaatgaataaattatattggcaaaaaaaaaaatagaataaattatactttattttccaactatttcttacttttttagttttctctctctctctataagttatatatttatatacaaaaagacgaaattcgtaaggcaatcttattggt

SEQ ID NO: 134 - DNA, 185 bp, Glycine max
  Clone ID: 240O17_region_G3__228643_13
gctatagcagctaggaactggtggaaaatgatgggtatcttggcctttttttagtttcacttttgtaatagcaaacttagcaataggattatttcggttgttgctgctttctcttgcctgcctgcctataactttgcaaagtgaccataaattttagctccgaagttcatgctctgatgatcaat

SEQ ID NO: 135 - DNA, 185 bp, Glycine max
  Clone ID: 240O17_region_G3__88478_19
aagataagatgaggtgctcgtcaaaacttctacaaaagaattggtcaaaatattttgagtcagtgaatatgctagtcacaaccctcttaacttgattttaaaaataaaataaaataaaaaacctcttaacttgcttcaaaatgaaacctcttgcattaatccaatcgtgcattgaatgagtataa

SEQ ID NO: 136 - DNA, 186 bp, Glycine max
  Clone ID: 240O17_region_G3__108950_13
agtgctagctggacgcacaaaaaaaattaaaattaaatcatgggccaactaaaaatgagtaaactaacaatagtaatgactaatgagttgtaatattaatcttcctcaaaagtaaataaataaatgagttgtaatagtcttttgttctattgctaattgtacacatttgatgattgattccagttt

SEQ ID NO: 137 - DNA, 186 bp, Glycine max
  Clone ID: 240O17_region_G3__121054_14
ctgcatggaaagatgaagcaggtatagttttggcctttttggatgttagcatttttctatatcgaagcataatattctataaatcagcattgtttttcttatttcccattattttgtcagtgtcttaccgtttacatatttgattatttatttattttgccttatagtctgccagggagaaagcac

SEQ ID NO: 138 - DNA, 187 bp, Glycine max
  Clone ID: 240O17_region_G3__188337_14
cacgtaagaccaagacctaacaggaatctttctttaaaaatcaaaagtgtcatgaacacgagcaaaaggccaacagctacgtacgtacatggtagttcatattaacaaattatactaccatcattctgttggaaaaataaaataaaaatgaaggaaaataaatacgaagaagatgcacagtcttgat

SEQ ID NO: 139 - DNA, 189 bp, Glycine max
  Clone ID: 240O17_region_G3__255944_21
taactttgccttaattggttgcacaaaactaatatttcatgattttatcttcctaatggggaatctatatatatatatatatatattgaaaataaagcaaataattgccccatactgcaatgaatagtggggaaaaaaatattttttgcaataaataaattactgtaggcagtgagaaggcaagaagat

SEQ ID NO: 140 - DNA, 190 bp, Glycine max
  Clone ID: 240O17_region_G3__219518_14
acgaaatgctcatgatcttctttcacaatgtgatataagacttcctgaggtatatatgtattctaatgtgttttatgcatattgatttgttttcatgtggttgggttgggttcattttcatattatactagtttgcttattctaggtactttcaattattttatgttacgctttctctctcctgcagatt

SEQ ID NO: 141 - DNA, 191 bp, Glycine max
  Clone ID: 240O17_region_G3__235601_15
acactcagtcatagccaagcctaccttgacattctcataaaaactaaccaaaagaagaagaaaaagaaatagtccttgaaatttttcttttcttattgaccaaaaagaaaacaacgaaaataataataataattattattattaggaaataaaagaggaaaatcatacttaccttgtcctcgtccaactca

SEQ ID NO: 142 - DNA, 192 bp, Glycine max
  Clone ID: 240O17_region_G3__301529_13
ttagtttacactgccggatcacgttcctctgtatttatttattttttcttttaaaaccatcgaattttttttagaattttttaattatgttgtgaattggtaatatttggttattaaaatattttaaattatgaaaatcaatattgtattattttgatttatgttgatgatttccaatggattagactgctc

SEQ ID NO: 143 - DNA, 195 bp, Glycine max
  Clone ID: 240O17_region_G3__94795_14
ccgtctccaacaccctctcatatatatgtttttgcttattattcaacatcatcaacaaatcacacacacacacaaacacaaagtgatatatatctccggagagaagaagaaacaaagagattcatttttagttactattatttttattataaattaaataataataataacaatgccttcttctcttcagttgga

SEQ ID NO: 144 - DNA, 195 bp, Glycine max
  Clone ID: 240O17_region_G3__46703_23
aaaccattcttcaacttgcaacacacgcacacacacacactcacacacactgtttttttgttccactaaatcaaaacctcttatctcttactctcattacattcattcttttgattttcgttatggtagtagcagtggagaaaaccaacctcacttcacaatcacaatgcttcaaccgtgtttctgacaagaaga

SEQ ID NO: 145 - DNA, 200 bp, Glycine max
  Clone ID: 240O17_region_G3__59616_14
tcatggtaacatggaggcaactatctaaaaaagaattgagattatttaaaaactaataagtgattgtgatagttgtgattaattaattaatactattgaagcaaagagacaatatatatagaaattgtggttttctgttgtttaattttgcttttggacaaagattaaacggttaaagtgatgatggtgatgatttaggg

SEQ ID NO: 146 - DNA, 206 bp, Glycine max
  Clone ID: 240O17_region_G3__296933_15
ttagtggaaacaagcactctctcctttttcttttcttttcatcattggatcaactttatatttttgtgctagtgctctagtgtcactctgctacttttgatgacactttgtagtgtttcatattatagttctgttttgtaattaagttctctttttccttagttattgtgcttgtttaaaatacatttggtggcaagagcatagaa

SEQ ID NO: 147 - DNA, 212 bp, Glycine max
  Clone ID: 240O17_region_G3__192428_17
ataacagcgaagcaatccattaaccaatatatatatatatatagacacacacattagtcacatgccaaatagtgggcaaatctcactcatgcaaaaacttcaaacagtgaaacaatttgatttttgttttccttttggaatcacgacatattattacaagacaaatacattataacttattagaagtgctacttcttggcaagctctattcg

SEQ ID NO: 148 - DNA, 213 bp, Glycine max
  Clone ID: 240O17_region_G3__191490_14
gcataatacattgtgtcttcatccattaatttttcaaacttactaaaaggggagtcaatcatattcatgacagatattttggcaaaataaaatgctattgcagaaaagactatgcaagaagaaagtgataactaatttttctctctaagactgttggaaaaataaaataaaaatgaaggaaaataaatacgaagaagatgcacagtcttgaat

SEQ ID NO: 149 - DNA, 221 bp, Glycine max
  Clone ID: 240O17_region_G3__201115_11
tctcattgatccttgtccatccataataaattgattttactgtttctacttttttaaatatttaagtagttaaactcgacaaatatttggttcgttagacattaatttgaaaagacaaacgatatatatatacataaaaaacaatatattttttgttccatcattttgcttgcatgatttatttattttacgaattggacgatggtattagtagttgtgca

SEQ ID NO: 150 - DNA, 221 bp, Glycine max
  Clone ID: 240O17_region_G3__72882_15
tgatcaccacagtaatatcaatcacaatagtcaaaataataataataatgaccttgatgtgaaaactgctaaagtgaattttatataaggaaatcattctcatatagaaatgataaaattacttattatgagaatgaaaacaataaattcttatttgaatggttagatttaaaaaatacatcacttcttattaagtggtcatgtgtgaacattaaattacc

SEQ ID NO: 151 - DNA, 222 bp, Glycine max
  Clone ID: 240O17_region_G3__69514_13
aaactttgcatcacattgttaatcttttacattaatttaaaatataattcacatattttattttttatttattatgaattttaattataatacatattcaaaattatttatttattataaattttagttaaataaaataaacatttatttttcaaattctacaagctaataaactagtattactaaatgcatagagtatgagcaaattcgtgtaggtggatt

SEQ ID NO: 152 - DNA, 227 bp, Glycine max
  Clone ID: 240O17_region_G3__37699_47
gtggaatcaagtgagggagaaactcatttttcaatttaactttaaaaaccaaaactaaaaaacttacaactatacattgtattaattagcatgtgttttatatatatatatatatatatatatatatatatatatatatatatatttgagtatggaaggagtactctattcaatgagatgaatatgtgttaacaaaaagattgattaggcgattaagaaagaagaga

SEQ ID NO: 153 - DNA, 228 bp, Glycine max
  Clone ID: 240O17_region_G3__11301_29
ccatttatacacacacacacacacacatatatatatatatatatatatatatatattattacttgttaaataaaatcagaaaaatgttgtaatcactttcaaaactgtagttaataaaccttaactaaatcaagcaaaaacaatggataagatggaagtttagtgatacaaaaatatatacaggtatagtgagaataaaaaagttgaggaagtgtgaaatctacgtga

SEQ ID NO: 154 - DNA, 236 bp, Glycine max
  Clone ID: 240O17_region_G3__141875_12
gctcatgattcgggccatattttaatttagaaaatgaaaatattttttaatataatcttgttttttcataaattgttatgtttatcttttgagaaaaatattaaagcaactttttaagtttttgtttttaattagaaaagcatttaattattattatttttaacatattgttaattgaaaaaatatttttgccattggtctgattttctacactactcaacacaacaatttgctca

SEQ ID NO: 155 - DNA, 238 bp, Glycine max
  Clone ID: 240O17_region_G3__98090_18
aaacacacactgaacttgttcctaaattatattgagtaattaactaccaaagttatatatatatatatataatattagtcatctttcaaaagtaaattatatatattgattaaccatttgatattttctgagcgtggaaatcggtgaaacggtgggcagtggcttttacaagttgctcttttttgttataaaaatttgcaagttgctctgaagcttctgcggattgtactgcatatgt

SEQ ID NO: 156 - DNA, 244 bp, Glycine max
  Clone ID: 240O17_region_G3__43298_35
tggttccataagactctcgaacaaaattacttccaataaaatatacatgtggtttataaaaaacaattccatcaaaattttccaaaaataatacaaaaaggatacaaatattttttttaaaaaaataattcatttattttgaatacatgacttttatatatatatatatatatatatatatatatatatcaaccgggacatagtaattcaagactacttaatgttgttcacccgtgatacatgt

SEQ ID NO: 157 - DNA, 248 bp, Glycine max
  Clone ID: 240O17_region_G3__262094_11
ggatccaaccgactagatcagtctaatttcaataactatggtcttgtgtattagaatcgaattcaaaatattttagttatggaacaaaactatatatatatatatgtgtgtgtgtgattatattacttttttaactaaatttaaattatagagatgatttataattatacatacaagttatgttatatgaagaaaaaataaaaatttagggggacaattgccccttcattcacaaagtgtcattagaa

SEQ ID NO: 158 - DNA, 248 bp, Glycine max; identical to SEQ ID NO: 157
  Clone ID: 240O17_region_G3__262079_15

SEQ ID NO: 159 - DNA, 263 bp, Glycine max
  Clone ID: 240O17_region_G3__59090_12
tctcatttatctatctcccaaggtgtgtacattccattagaatgtgaaaatgaaaaacattcacaagcataatgtaaaaaaaataatattatttctcataaccctatatatatatacacgccacataatacgtacgaacgtaagtgatactatcatgaaagttcttgaatggctttcttttcagggtgaatacatatattaatggatagtggtttttgttggtcattgtttcttattattatgtccttaggcacggtgttagg

SEQ ID NO: 160 - DNA, 265 bp, Glycine max
  Clone ID: 240O17_region_G3__245723_13
aacgttgatgtctactgctcccaatccaacactttactcttcttcctttttttcttttctcctcttctttttattctttgaaaactactaaattcaaagcaaatcttaattagaaagcaaaaaagaaagacataggttaatgatatttttgctctctcaattttcacactaaactttttagttccataatcaatatctaaaaacacgattaagaagaagaaaaataaataaatagcaagcaaacaaacaattattatccacgcgc

SEQ ID NO: 161 - DNA, 266 bp, Glycine max
  Clone ID: 240O17_region_G3__194628_54
gattaggcacccataatataaatccttttttcactatatgaaaaatttatatatatatatatatatatatatatatataaatatatatatatatatatataattaatttttacaataattattttaaatattatacgtattacaatatctcattactttacattgtaaaacattttacaatgaaaaaactcctagattctataaatattttcttttagagttacaattttattacacggcaactgacgtgtcggagttggtaacat

SEQ ID NO: 162 - DNA, 268 bp, Glycine max
  Clone ID: 240O17_region_G3__4566_16
ccaaacacctcctcaattgtagacctgtatttcaaatattaactatatgaaacttcaattctaattgaaaaataacaaaacaatacttatgaattatatgtaagtgttgtcctaaactaaactaaaccaatcaacaaagaaaataactcaaattctaattgaaacaaatgaaaagatcatttcactgttctagataaattttatgatatataatgtaaaagtgaattaatacctaaattaagatagtacacaggcaaacttcaagaaa

SEQ ID NO: 163 - DNA, 274 bp, Glycine max
  Clone ID: 240O17_region_G3__96209_14
ttgatgagctggctggttagttaaatatatatttttacttattttaatacaaatgctaattaacttgttgacccaacatattatttaagaaaaataaaataaaaaatatttttattagaaaggaaaaaattatgtttttgttgattttttatacccttttaaaatttatataataaatatttttctcatttaattttttaacatgtgctaagaacatttatgagtaatatttttatttgtcatattttgaagagggagcgaaagcctacattac

SEQ ID NO: 164 - DNA, 274 bp, Glycine max
  Clone ID: 240O17_region_G3__248715_17
agcaaatgctttaattacgctgaaaaagtatccttttctttttttttgaaattattcaatgaattaaatatcacagtgaaatttaaattaaattaaattgataacatatgtatttattttctaatttaaaaaaaactgtcaaaaaaaattcttttttatataaggatgatgttaatttaatttatttttgagttgttaatcttaacaatacgagtagctataatagacagcgatatcgagttgttaatacgagtagcaagcaataccacaagaa

SEQ ID NO: 165 - DNA, 280 bp, Glycine max
  Clone ID: 240O17_region_G3__71410_40
gagtccttcaaattggcgtcttttttctcgttttggttcccagtacttaagtcataataataataataataataataataataataataataaaagtttaggaagaaaaatgagaaaactaattagtttcgggttttatttaaggtttttttagtttcagaaactaaaatgacatatagatacaaatttaaagattaaattcgtcatttactcattttttattagacaaaatttaggtttaagcatgcataccttttgtttcttgaatctagccaaactt

SEQ ID NO: 166 - DNA, 284 bp, Glycine max
  Clone ID: 240O17_region_G3__226519_13
ataatgcccacgatccaagtgtattaatatttaataatgatatgatatgtcacttcttacacacacttcatacaaacaaaatcctcaccatttcttttttcattttgttttccttttacaccatatatctcacattttttaggaggggaaggataaggttatatcactttatttgtgtaagtaacttttttggattaataattgattattattattaaataagacaacccgaatataactttttcatttttgagggagcatgaaagttggagtacggaaatgga

SEQ ID NO: 167 - DNA, 285 bp, Glycine max
  Clone ID: 240O17_region_G3__11282_19
cgaaattcgtaaggcaatcttattggtattataattttctctactgattatgtctaaccatttatacacacacacacacacacatatatatatatatatatatatatatatattattacttgttaaataaaatcagaaaaatgttgtaatcactttcaaaactgtagttaataaaccttaactaaatcaagcaaaaacaatggataagatggaagtttagtgatacaaaaatatatacaggtatagtgagaataaaaaagttgaggaagtgtgaaatctacgtga

SEQ ID NO: 168 - DNA, 286 bp, Glycine max
  Clone ID: 240O17_region_G3__170504_12
aaccaaacctgggttgaacttgttttactaaataatttgtttaatattttaaaataatgtcttaattatattgaacaaaaaataatattatatattaataataataaataaatttcacttaaaagtgtcattaattataaattttttttaaccaaagcgatatcgttttgataagttaaaaaaaaaaacggttaatacaagtttttaactgatttaacgattttaaatcgatgtaaggatccattaatttttaggagctcccactggcccgatttggatttcattt

SEQ ID NO: 169 - DNA, 287 bp, Glycine max
  Clone ID: 240O17_region_G3__40864_14
ggactgattggtacgaccattagtttaattagctccatggagaaaagcaagataaaattgctaattattggttaagaaaataattgcaccagatatattatataaaatgtcaaaaacgcattccgtacattataaataatattatatacgtcatatttacatcattttttatccttgtttatctcaaaaaagtgtaaatatagagagagtatatatcatatcatataatatgtaagtttttattagtttaaaaaaatagcttgagagtaatgtgatttgtcatgtgc

SEQ ID NO: 170 - DNA, 291 bp, Glycine max
  Clone ID: 240O17_region_G3__13529_14
cgtgccaatcatcgatacagtacaaataataaattaaaatgcaatttttttcttgttcttattttttcttatttctcttaaactagatactatcgaatccattctatttcttatctgtttccattattctacttctcacttattttcattactttattcctttcttttatgtttctatccactttatttatcacctatttctttctttcttaccgaatactaaacaagccttgtgatccgaaagcccgaaacaatcattttttatgaaacagcttacactctggtggtgtg

SEQ ID NO: 171 - DNA, 291 bp, Glycine max
  Clone ID: 240O17_region_G3__22858_14
tcaattaaagggataaggacccatttatttaagcttttaaaaaaatatttttttttacatatttatgtaaagttattttatttggttacaataattaaaaaatgtactttatattataaaaagtagttataattttgactttttttcagctgctactcaaagtagcttctgaaaataatcatatagatagatagattctgattttttttctaaaaaaaaacttaaacaaacacactaagaaattttagaagtgatttttcatgaaaaaagttgaaacaaatgggctctaaa

SEQ ID NO: 172 - DNA, 292 bp, Glycine max
  Clone ID: 240O17_region_G3__309211_13
aaagttgaatggtttgacagagataaaatgagggggattggaataaaaaagttatgaggttcattattaattccttatcaattcatcacatatttcttttcacctatttatctatttcctatttatttattttcattattcctaaactaaataactttgtttctattctacttcttatatatttctattcaccttttttaatttctagttatcatatcttgtacttcttttaatttttcttccaaccaaacatatttagaaactactcttgggataatcagcagtagtgttt

SEQ ID NO: 173 - DNA, 293 bp, Glycine max
  Clone ID: 240O17_region_G3__55568_26
aggcatagaagcactaatggtgacacacactagtataaaaatacttttaatatcagttattttagatttttttgtttgtgtaagtcaatcaattttaaaagttacttctaaatcaactttaacaaaaactaatgtagaaatgatctagaaaactttttttttaagttctaactctttttcatcaatgttatacatatatatatatatatatatatatatcccaaaataaccaatcaaataaactacttagtttacttatatgttaaatcatcgacctattacaagagaggagg

SEQ ID NO: 174 - DNA, 300 bp, Glycine max
  Clone ID: 240O17_region_G3__73238_16
tggtcatgtgtgaacattaaattacctttaatctttatcataattactcttttcattcttaaattaagattttttttctaatttctagatatattaattatttttttcttaaatattcttacttaattattttctcatcaaatattaatgagatgaatagagaaataagaaaagaataatttttgaatgataatataattaattaattaataaatttaatgtgattaattaaattaattatttttcttaagacacataaattagttgaaaggtaattgtaataagggacagacggagtga

SEQ ID NO: 175 - DNA, 300 bp, Glycine max
  Clone ID: 240O17_region_G3__52488_19
atgtgcattggatgttctaccatagtacattgctttatgtgaaagtcttttaattattcaatattgacatgttcttatatatatatatatatatgagggattgtattatctctgaaaaaagattttatcataaaatcataatgatttctcataatgtatctttacattttaaagttagataaataaaattgattttaaattgttagatataattaaaatacataattaatatgacttttaacaaattgatatataaacacttaaaaaaaagtttcatgacgtacggtgtgtattgttggt

SEQ ID NO: 176 - DNA, 104 bp, Glycine max
  Clone ID: 318O13_region_A3__471518_14
ttgcaactacctgcaacgaggatactcacacaatgtgtagttatagccaagagtttttcttttctttttttcctattaggagaatctcgcgtaattacataatt

SEQ ID NO: 177 - DNA, 105 bp, Glycine max
  Clone ID: 318O13_region_A3__231599_23
cttcaaggctttggagaacaaacatgacaagggaggaggaggaggaggaggagggagcgttgctgaatccgacagcgactccgaggaggaggagtacgaggacct

SEQ ID NO: 178 - DNA, 110 bp, Glycine max
  Clone ID: 318O13_region_A3__375912_13
gacgcatctgtcacgaacgacggcctgcagcgaggagttctcgcagagaagacgaagctgctgtcgcgaagaagaagaaggcgtcgcgaggaagaagaaggcgtaggttt

SEQ ID NO: 179 - DNA, 110 bp, Glycine max
  Clone ID: 318O13_region_A3__180013_12
accagtactcctggagggtctcacccttccaggcgaagacggcggcactgtcgcgggcaatagcggcggcggcgtggtcctgggtggagaagatgttgcaggagcaccag

SEQ ID NO: 180 - DNA, 113 bp, Glycine max
  Clone ID: 318O13_region_A3__171606_14
gcaactcgacatattctttgggattttgatgcctatttgttacgaagtctatttaatatagagtttagtttagttatcaattgcagggacttcttcagtcccacattggaaag

SEQ ID NO: 181 - DNA, 114 bp, Glycine max
  Clone ID: 318O13_region_A3__416256_13
aacaattgcatccggtcattctaatgatatattatttcatcccacatcctccccactaaacaaccttctatgttgatctctctctctctgtctggcctcttgagtgtgagaatt

SEQ ID NO: 182 - DNA, 123 bp, Glycine max
  Clone ID: 318O13_region_A3__231395_15
gtccttcccgcactaatttatcgaaaatctcccttcccagaaattaggttttagtatttctttctttctttatttatcagcgattcgtggcaatttttcgaaggtagggtttgatgggtgatc

SEQ ID NO: 183 - DNA, 125 bp, Glycine max
  Clone ID: 318O13_region_A3__5502_47
cagcaagagttgacgaatgatgaacatgcttcaaatggagttatatatatatatatatatatatatatatatatatatatatatatatggtcttgcacgaggtatgaggttgtcggtgttaaagc

SEQ ID NO: 184 - DNA, 125 bp, Glycine max
  Clone ID: 318O13_region_A3__93061_14
acagcatcagaactcagaagcattggttgcatcagagttttgttatggtgtatttagaaaaatctttcttgaaaaaataaaataaaacggtatttcgccaacaggtcagcaacaacgttagcctc

SEQ ID NO: 185 - DNA, 127 bp, Glycine max
  Clone ID: 318O13_region_A3__111684_19
cttctccataacacttcccaccaacccaagttcaacacctctctctctctctctctcacacaaacacttctcccaaccctaatgtctctccccaaaaccctactttctctcttccttctcctcacga

SEQ ID NO: 186 - DNA, 128 bp, Glycine max
  Clone ID: 318O13_region_A3__69328_14
ctcctcagccaggttacgcttattgacccccacgcgcgccagggctctaaagttgtccccgttgctttgaacaaggtccttcctctctctctctctgtttccgttctttatttctctctcgcgtttgg

SEQ ID NO: 187 - DNA, 130 bp, Glycine max
  Clone ID: 318O13_region_A3__36529_17
tcagagacttctttgcttggatgaaattgcaggttcacttcctctctctctctctctccttacttcaatcttgtgttgcgtagaatatggtttggtttataaaaattgtttgcatcgtttcctgtagttg

SEQ ID NO: 188 - DNA, 132 bp, Glycine max
  Clone ID: 318O13_region_A3__139128_12
cagttcggcgatatctgattctaccttcactggtgtaagatactaaacagccactttggattttacttgcacgcatatgcgcatgcacacacacacataacaaacactgacaaggttcaagaacttcactgg

SEQ ID NO: 189 - DNA, 132 bp, Glycine max
  Clone ID: 318O13_region_A3__495674_13
aagaatccaggaccatgaccctattaatgaaaaaacctgggaaaaataaataatatataagaatatatgtaagctccaggtccaaacaaacaaaccaataataagttaataacatcagagaatgaccgcaaa

SEQ ID NO: 190 - DNA, 132 bp, Glycine max
  Clone ID: 318O13_region_A3__187577_13
aaacgaacacatacgcactcacatttccattccacctcaacaaacacaacaacactctctcttctcgctcttggcttttcgctcttcactcactctcattcattcatttccaccgttcatggatccagtaag

SEQ ID NO: 191 - DNA, 134 bp, Glycine max
  Clone ID: 318O13_region_A3__453036_14
caacaatccgtgttgataagagcaaaatatccttttattatttatttatttgatagtcaatatacatattttgcctcgcacccattaaagagttggggtcataatgtaatttcgggactagaagtgctttaggg

SEQ ID NO: 192 - DNA, 134 bp, Glycine max
  Clone ID: 318O13_region_A3__374041_13
aatgcaaagtaacaaagcaccctgtctaagtgcaatacgattaactcttaaggtaacgatagcttcttgatagcatgttattattattatgtaataataacatgctttttggtcattattcatggtggaacaaa

SEQ ID NO: 193 - DNA, 136 bp, Glycine max
  Clone ID: 318O13_region_A3__3412_11
aaacactccaatgccaccatctcaacacccttttctgccgccatctccacaacgcaaaatcagttcagggattcaaaaaaaaaaaaaaaaaccagagagagagaaagtgaaaaaggtgttggctttggttaaggtt

SEQ ID NO: 194 - DNA, 137 bp, Glycine max
  Clone ID: 318O13_region_A3__276495_28
ctttcaagccgcagggttagatacgtgtcttagttattattattattattattattattatatgtcgaagtcatacttagttatgatagctagctaactcttttattaactataataattggctacacgttgcagct

SEQ ID NO: 195 - DNA, 139 bp, Glycine max
  Clone ID: 318O13_region_A3__151839_17
ccgcaatggtatctctctcagacttgggaacaaacacaggcttcaccatagccactcccgtatattcctcatcagagtcagtctcatactcagattcctcctcctcctcctcttcttcttcctcctcttcctcttcctg

SEQ ID NO: 196 - DNA, 140 bp, Glycine max
  Clone ID: 318O13_region_A3__292912_12
atatgtttgcgtttctgtgcttgtgtgttgtccgtaaatatatatatatctcatcattattgttagtgttattggtcatgtgtttctttttctttattttttttctcactttctatgctctttctctctattcctaaggg

SEQ ID NO: 197 - DNA, 141 bp, Glycine max
  Clone ID: 318O13_region_A3__104560_12
aagagacaaatggaggaaattgcacgtgggttattagattgtggacgtccatttttgtgggtcgttagagaaaaggtaattaatggaaaaaaagaagaggaggaggagctttgttgtttcagagaggaattggagaagtgg

SEQ ID NO: 198 - DNA, 141 bp, Glycine max
  Clone ID: 318O13_region_A3__65193_11
tagtggaatggaagcagaacagagggagggttggtgtatgtgtgtgtgttagagtaagataaacagagaagctgcagagaaagaagagggtaattacaatggaagtggactagtacactcctggtttggaagaacagcata

SEQ ID NO: 199 - DNA, 284 bp, Glycine max
  Clone ID: 318O13_region_A3__110573_70
cacattgaaataaacatgtacgacacacatatatacatacatatatatatatatatatatatatatatatatatatatatatatatatatatatatatatatatatatattttggcagcacacataaatattatatccagcgtcagcgttatcctcttcttcaaagggattgacttcccgctccctgccacgatcccatccaccacttttgtttccccatccacctgtacgtccaccaccaccaccatacccaggacgataatcatttctgggtgcagcataac

SEQ ID NO: 200 - DNA, 144 bp, Glycine max
  Clone ID: 318O13_region_A3__65117_12
tgcagtgtgagttcttctttgatcctggttatccattgacaatgaaagagagtaagaaaatccaacaagtgaaaaacccagaggaagaagaagaatggagaggccagaaaaaccaaaactttagtggaatggaagcagaacaga

SEQ ID NO: 201 - DNA, 144 bp, Glycine max
  Clone ID: 318O13_region_A3__490837_16
agagaacgaacggtagcattctcagtcaaaggtgaggagtatggacgatacataaatgttagttgcgaacaactctctagtctagtctagtacatcatgtttaggttggattagtatttaggaaagtcaacacacaatgcatgt

SEQ ID NO: 202 - DNA, 145 bp, Glycine max
  Clone ID: 318O13_region_A3__107448_11
tcagaaagtttccctacttgattgagggtagttttttcttaatactagctgagtgaaagaaggatatatatataatccaccggcagatttgggttctgttaagtgatcagttatttctaaatcaaaccagaaattgatcgaagga

SEQ ID NO: 203 - DNA, 146 bp, Glycine max
  Clone ID: 318O13_region_A3__331_23
ccattgtccatcctctctaatgtttcttttaccctaaactacagcttactaccaaaaataaataaataaataaataaaactgtaagtatagcataaccgcagacaaaatgctatagatagttaaatccaacactggacatgtgaaa

SEQ ID NO: 204 - DNA, 146 bp, Glycine max
  Clone ID: 318O13_region_A3__193470_13
taggcatagcttaaggcatggtattaattattattattaatatgtggcagactagagtggtagatatcttacttggttgagttgatgtaattaaagacagcactaccatcagtaaaattgatatgagaagcaggaaggacatgagg

SEQ ID NO: 205 - DNA, 146 bp, Glycine max
  Clone ID: 318O13_region_A3__183305_14
ggagattaatttgatgaaccgaccaaaaatattggtacagcataatcacaattattgagaagatatttttattttatttttaccgaatcgtcgcacgactcggcgtgttgcaaccgcattaaatctttgtgttggtctcaccctgt

SEQ ID NO: 206 - DNA, 147 bp, Glycine max
  Clone ID: 318O13_region_A3__55050_14
tctgacccttaataatcaggcaacaaaaaagtaaaataaaaaatagtgttttaaaagaaaagaaaaaatcaaaagacaacaagtcaaatataggacgcattatgcaaaacgcggttctaacttctaaccgggcaagtagaagattct

SEQ ID NO: 207 - DNA, 148 bp, Glycine max
  Clone ID: 318O13_region_A3__224693_21
tggtgctaagaaagtgtaatttgtggactcgttagaaaaataaataaataaataaatagtaaataaaagggtaggtataactacaactataagggaaaagtcaaaacagtctacttagttatgcggtacaccacatgtttgaaagaaa

SEQ ID NO: 208 - DNA, 148 bp, Glycine max
  Clone ID: 318O13_region_A3__207216_12
ttaactttgttagaggaggcggagacagaggaaagagatgtttaaatcactctttgtctttgtttctctctctctcccgttgaagacctagatgacattcgacagaggagagagggagaaggagaacatgaagaagacaacgagccag

SEQ ID NO: 209 - DNA, 149 bp, Glycine max
  Clone ID: 318O13_region_A3__4654_22
ctgaagaaagcattgaccaaggaaaacggaacgaggagctggtatatatatatatatatatatactgagtgctgacaaggtaagtttttgtctactgatattacacatccacaaagaatattatctgtgattgtgggttaagatgggtt

SEQ ID NO: 210 - DNA, 149 bp, Glycine max
  Clone ID: 318O13_region_A3__408959_13
cggttgttggaagaagttgttgttagggtttgcagactgctgcggcggcggcgggtgtcgatagccgccgcggaactggaaagggtggccgtacattcgcgggaaaaataagaagcgaaggcggcacaagcagaccacgctaactacac

SEQ ID NO: 211 - DNA, 149 bp, Glycine max
  Clone ID: 318O13_region_A3__132288_22
acaggtcatctaaccaattgcatgtatactacggttatgcgatcagttacatgtatactacagatcatgtgacattaatgaccaaaaagtaccatatattattattattattattattgtcatacaatggtgtccaagacataagcaac

SEQ ID NO: 212 - DNA, 149 bp, Glycine max
  Clone ID: 318O13_region_A3__292822_20
gctattcacaaagcaagagccgttattagtctctagattctgggttttgttgtttctctttgtttaccactctgcttcttttcttttcttttcttctgttctctctctttctctatcaggttatgggtatatgtttgcgtttctgtgct

SEQ ID NO: 213 - DNA, 149 bp, Glycine max
  Clone ID: 318O13_region_A3__311076_12
tttgtacttcgcacacatttgaaggtatgaaagtaggtagaatattttgtcttcttcttctatgggcgaaacttgaaaacttctaaaaatacaattttaccattaaattaaaatggtgtgcccatactcaccttgggtaggagaggaaa

SEQ ID NO: 214 - DNA, 149 bp, Glycine max
  Clone ID: 318O13_region_A3__509623_13
aatgagcatagcgaagcctcctaaacgctttggtttcttcaccaccaccacccttctttctctctctctctttctaaaaaccagaaacaacaaacacaaaccgaaaaggcgaaaggggttttccgagtgagatctagggtttccatcga

SEQ ID NO: 215 - DNA, 149 bp, Glycine max
  Clone ID: 318O13_region_A3__190404_14
aatctggtccctcaaagaacaagtgttgcagcagtaaaactgcatacaccccaccccacctttacacgagaaccataagataaaaataaggaaacaccagggcacgcatcttttcctatactctcaccaaacttcttgcataagggaaa

SEQ ID NO: 216 - DNA, 150 bp, Glycine max
  Clone ID: 318O13_region_A3__164916_15
aggctacggtatagaccacgttgaagtcaaacaaaaccgctttttctctctctaaagtgcatagcgtcagcgtagttgcaaattccaggttttcttcttttactcaattctctctctctctctgaggttctggaaagatcaattccattc

SEQ ID NO: 217 - DNA, 150 bp, Glycine max
  Clone ID: 318O13_region_A3__21028_13
gatggataattagtcttggccatcattaaacaaacaaacacttggctattcaattccatcaaaattctgacaatctttttgtaacggttaaacctccaactttcggagtggtgggggcttcctgatcaaagttgcttgctcaaaggaata

SEQ ID NO: 218 - DNA, 150 bp, Glycine max
  Clone ID: 318O13_region_A3__208012_17
gttacaacagctacctccgcagactcaacagcttcaaactccttaagacatccttcatcctcctcctcctcctctacaccctctccacccaccacctcctcctctcctccgccttccacggccccgcatgggagaatcaggtccgccact

SEQ ID NO: 219 - DNA, 150 bp, Glycine max
  Clone ID: 318O13_region_A3__484089_14
cgatcgcatgatagagttcaccaatcgttgaccccgagtcaacccacgcagtgtcatcatcatcatccaagttgactttgactgatctgagcataaacatgtcaagaataacaaatggggcttctgaaacgtaggagaggccatcgtagt

SEQ ID NO: 220 - DNA, 150 bp, Glycine max; identical to SEQ ID NO: 218
  Clone ID: 318O13_region_A3__332780_17

SEQ ID NO: 221 - DNA, 150 bp, Glycine max
  Clone ID: 318O13_region_A3__480137_37
ttcaagggaaggagaagaatagattttttttataagagatgaaaaaacgtgaagaatgaagtttagagagtgagatacgttagttagttagttagttagttagttagttagttaggaaattgagatggattaaaggaaacttaataggga

SEQ ID NO: 222 - DNA, 151 bp, Glycine max
  Clone ID: 318O13_region_A3__441056_14
ctaatttgcgaacaggccacaagtaagtagtaataaacaaaaaataataaataaataaacagttcgcttctaattcattttcatgataaatgcagttacattcatctcccctccccaattccatttccttccgccaagaaatttcgtaatc

SEQ ID NO: 223 - DNA, 151 bp, Glycine max
  Clone ID: 318O13_region_A3__77486_11
atacccaaatcccatcttccatttctctctttttcacacatatatatatacccctcttttgaacacattccctcacatcatcacaagaagcacaatttctctttctctctttttttgtgtgtccaaaatggctcctagttctgctcacaac

SEQ ID NO: 224 - DNA, 151 bp, Glycine max
  Clone ID: 318O13_region_A3__272468_11
attggatccatcctataaggcaggtatactttaaattcgagtaaaatatatatatactcacaagttcacaattaattttcgtgtatatcaccagcttgcatagctgaatacgggggaacatgcacgttcgtgttactgatgcaacgtacaa

SEQ ID NO: 225 - DNA, 151 bp, Glycine max
  Clone ID: 318O13_region_A3__425319_17
taccagtgaaggatgaggtgactgtcatggactagaagtttgtaaaggtgttcctacaatatcacatgtttcactcgcaatgattgttttattttattttattaggctttgatattggaagtttgtatggatacgcccttagtatgcttca

SEQ ID NO: 226 - DNA, 151 bp, Glycine max
  Clone ID: 318O13_region_A3__413879_31
gatcctcagccttagtttgctgagagatgtttgtgtgtgtatattatatatatatatatatatatatatatatatgagaattgacagatagtacaaaaaatagttcatgatgaaggctacagcctagcctatggtgacagattacaggaca

SEQ ID NO: 227 - DNA, 152 bp, Glycine max
  Clone ID: 318O13_region_A3__80477_64
ggttggcctgaataatttgcaatagttccattcgtacatatatatatatatatatatatatatatatatatatatatatatatatatatatatatatatattatataaatgctattttgaaccatcttctgctatcaactatcccacttccc

SEQ ID NO: 228 - DNA, 152 bp, Glycine max
  Clone ID: 318O13_region_A3__277272_50
cctgatggtactcgcttctctctctctctctctctctctctctctctctctctctctctatatatatatatatatatatatatatatatatatatatatatatatatattgtctgataataaaaaaaaatgttgtgcatgttcaatgacaga

SEQ ID NO: 229 - DNA, 152 bp, Glycine max
  Clone ID: 318O13_region_A3__509642_13
ctaaacgctttggtttcttcaccaccaccacccttctttctctctctctctttctaaaaaccagaaacaacaaacacaaaccgaaaaggcgaaaggggttttccgagtgagatctagggtttccatcgattcggagagaggatattgatcga

SEQ ID NO: 230 - DNA, 153 bp, Glycine max
  Clone ID: 318O13_region_A3__321771_14
atcaaactctggaaacaggttggtggggggggatagagatacgataagataattttgtgtgtgttccacatgcgtatataagtcaacgatctagatcaaaccattatcataataataataatcaaaccccattaattccaaggtgttgctgac

SEQ ID NO: 231 - DNA, 153 bp, Glycine max
  Clone ID: 318O13_region_A3__26788_12
gaagagacaattgtgaggcaaatcatcatgtgaacacctagtggaataaggcttttgttgttgttgaacaaatcacatgaacaaaatgaacacaaactggaggattaatctatatgttgcatgtgtcataagcagagaaccatgattggtctg

SEQ ID NO: 232 - DNA, 154 bp, Glycine max
  Clone ID: 318O13_region_A3__262706_16
ttccttatcacccaacatccaaactgggccatctataaaaactataagctgaactgagtgtgtgtgtgtgtgtttttatcattaactaggtgtgtttatttatctttatcaagtgtactagaatgtacgcatttatttcccgcactcctagtgt

SEQ ID NO: 233 - DNA, 154 bp, Glycine max
  Clone ID: 318O13_region_A3__243928_16
tggcatgtgaaacctaaataaacaaatatatgtattaaaaataaaataaaatatttcgtaaaaatttaaatctggattatagtttatcaaatagatgattatgtaagttttccgatccccactctaaagttatcttcccaggcataccctgata

SEQ ID NO: 234 - DNA, 154 bp, Glycine max
  Clone ID: 318O13_region_A3__23246_14
aatcacctttctctgtccacctctgccattactcttctcttctctctccctaaagctgctgtataattacttgattaacccttcctcatatgccttagtttgacccttctcaactcgataaaatacatatgattggcttacaaatttgagcctt

SEQ ID NO: 235 - DNA, 155 bp, Glycine max
  Clone ID: 318O13_region_A3__165406_12
ggcactgagctgaattgtaatgttgcatgtgtatgatgaatgatgatgatgtgagatggagaaaaatgtatagggagatagagagagcttcaatttgaatctcatagagtctatttgaagatatatgttacttagggttaaagagatcgacaagg

SEQ ID NO: 236 - DNA, 155 bp, Glycine max
  Clone ID: 318O13_region_A3__486294_14
cttatggccatgctatacacatgctaggattataagtataaatagtgatctttcaggaacaaagaagccattctacagcaaaatcgctctctctctctctttcagcttagagttttaccttatcttctataatggatcatggaaagcacttcagt

SEQ ID NO: 237 - DNA, 156 bp, Glycine max
  Clone ID: 318O13_region_A3__46754_12
aatccaaagttgtcaagatggttccagatttatcatgttcgttccatttatttttttactatttattgtggtttatgaatatgatggtgatggtgatgatgatgaagttccaacatttagaaacaagatttttcaaatctaacgatccgacaatga

SEQ ID NO: 238 - DNA, 156 bp, Glycine max
  Clone ID: 318O13_region_A3__381116_15
aaaggtgggtgtgcttcccatttatatatatatatacatacatacatacattctttctcaaaactcttctttaatgcttaaaaggttgtccttttatggtttccagaggaaagataactttgaatctgtagtaatggagcatctgagaatgaatgg

SEQ ID NO: 239 - DNA, 156 bp, Glycine max
  Clone ID: 318O13_region_A3__350369_11
aaaggttgaagaagatgctgcgtaattccaattccagaggaggatttggatcaggaatggtagtggcagtggtatgtgtgtgtgtttgcgtagtagcaatggagtatggagtaagagtgacggagggggaagagtatttcaaaccgttcaacgtga

SEQ ID NO: 240 - DNA, 156 bp, Glycine max
  Clone ID: 318O13_region_A3__138841_13
ggtgcagcttaaacaatttctgtcaaaacgtgtagtttggtgattttatatatatatattggtgatgaatattcaattcaatgcaggaacaggaagggataagcctgactttctggccacagtggatgtggatccaagctctccaacgtattcaaa

SEQ ID NO: 241 - DNA, 156 bp, Glycine max
  Clone ID: 318O13_region_A3__12158_14
cataccctttcagagtccctgtcactgcaatccaagaaaacaaaataaaataaaaaaatatacatgtagaagagtttatttgcattttaattatgaaagctaactcccaatcgagtacttgcaattcaaaacgaaacgaatttcatacttcctcca

SEQ ID NO: 242 - DNA, 156 bp, Glycine max
  Clone ID: 318O13_region_A3__315368_13
cagtcagagaaaggaagcatgcactgcatctaccttaatctacctacccacacttttctatatatatatatccacccttccaagccactttgcaacatccatccaagccttttctttcgtagatagctactacttcactttcatcctttgctccag

SEQ ID NO: 243 - DNA, 156 bp, Glycine max
  Clone ID: 318O13_region_A3__307549_13
ctggagcaaaggatgaaagtgaagtagtagctatctacgaaagaaaaggcttggatggatgttgcaaagtggcttggaagggtggatatatatatatagaaaagtgtgggtaggtagattaaggtagatgcagtgcatgcttcctttctctgactg

SEQ ID NO: 244 - DNA, 157 bp, Glycine max
  Clone ID: 318O13_region_A3__159857_14
tcctcctcctagttgtgcttctcttttctctttaatgaatttcctcctatgtaaaaagcaatagaaaaagaaaaccagttttaaaaaaataaaataaaagaactaatttcaggtaccttcttccattttgcaattagattgcggtcagcatatcctt

SEQ ID NO: 245 - DNA, 157 bp, Glycine max
  Clone ID: 318O13_region_A3__140551_15
gattcctggttcttggaatttcctttttaattttcttcaccttttctatatattgtatctgtgctcatatgaaataatagagatgatataattttcatactctactctactcatagatatccatactcattttgtattgtcatctggtatgcgtttg

SEQ ID NO: 246 - DNA, 157 bp, Glycine max
  Clone ID: 318O13_region_A3__279869_11
taatgtgccaacttctagcaaggatggggcgtcattcattgtgagggaccgaaccatgttcttaattattattatatatatatccatgaaatatattttttttgcctcctaattaaattttctacttctatcataaatttggccataagcccagact

SEQ ID NO: 247 - DNA, 158 bp, Glycine max
  Clone ID: 318O13_region_A3__78292_35
caaattgattagtttctttccttctccatatatatatatatatatattatatatatatatatgagctaaaacagtaatactgtagagtttttgtatgtgtgtgtatgtttgtttttcttttaggtagttttagcattgattcttgatgaaagaacatg

SEQ ID NO: 248 - DNA, 159 bp, Glycine max
  Clone ID: 318O13_region_A3__185019_12
aaccttctcgcgtagcttgagtagatcttaaaattggatatttgctcaattaatacgcttataatatagtagtagtagcctagatctagatgcagtttgtcccgcgttgtaattaaataaaatatcacggaattattatgagagcattggtgagcatga

SEQ ID NO: 249 - DNA, 159 bp, Glycine max
  Clone ID: 318O13_region_A3__409164_13
aggagaaacatcagcatcattacggggttttgtttagtactaatgtaattgtaaattttgtcatggcgcggttcggcttttcataaataaataaaaataaagtcctcttgaaacacaactaaaaacacatggagatttttcttcatgcacccacccttt

SEQ ID NO: 250 - DNA, 159 bp, Glycine max
  Clone ID: 318O13_region_A3__75392_14
gaaggagcctcatcattgacctaaggggatgaaatcacactctttttatgatctatcctttgcttttcacgaaggctgccatttgatgaggaataagtagttttgattaattaattaatggacctatacatgtgacgatatcaaccatcaatgtcatcg

SEQ ID NO: 251 - DNA, 161 bp, Glycine max
  Clone ID: 318O13_region_A3__231320_12
ccctaacaatcatttcaacgccttttctctctaatcttgcaaatcttggaaattattattattgaattgggtccttcccgcactaatttatcgaaaatctcccttcccagaaattaggttttagtatttctttctttctttatttatcagcgattcgtggc

SEQ ID NO: 252 - DNA, 161 bp, Glycine max
  Clone ID: 318O13_region_A3__381102_14
ggccactgagaaacatgttcgatatatattatcagttgaaaaggtgggtgtgcttcccatttatatatatatatacatacatacatacattctttctcaaaactcttctttaatgcttaaaaggttgtccttttatggtttccagaggaaagataactttg

SEQ ID NO: 253 - DNA, 162 bp, Glycine max
  Clone ID: 318O13_region_A3__491826_15
cttgtggcgatggtcctctttaataaatgtgttgcagttcatgggtcaaaccaacccaactttgaaggcaaaggagagagagagagaggtcaagggttttcttttttccgatttgttgatcgcagaaaatatcatccttttgtgggattgtgaagattggtc

SEQ ID NO: 254 - DNA, 162 bp, Glycine max
  Clone ID: 318O13_region_A3__56365_21
catgttctccacaaggaaacagagaaaaaagagagagagagagagagagaagaaacaaacgatgcagagaagactataccgaaccaacttcaaaatggaggaaacatcagcagggcaaaaaaaaaaaaaactttaaagttgtgcctgaaactgtagtcatgg

SEQ ID NO: 255 - DNA, 162 bp, Glycine max
  Clone ID: 318O13_region_A3__372628_15
aaaggaaatctgaaatcctgtggaattagctctacaaatgcatattgatgcacatcgcaatccaaaaaaattaaaaaataaaataaaattagatgaaaaaaacaaataaagaaagaacttaagaaatactagaagctccatctatcagccaagtaacaaccc

SEQ ID NO: 256 - DNA, 163 bp, Glycine max
  Clone ID: 318O13_region_A3__302609_11
cctacccacttcaagttcaactgtctatctattcatatatatatacccacccttccaaaccactttgcaacatccatccaagccttttctttcctagctactacactttcattctttgcttcagaaaattaactagctaggatggtcagtgttgaagagatcc

SEQ ID NO: 257 - DNA, 163 bp, Glycine max
  Clone ID: 318O13_region_A3__341804_11
ggatctcttcaacactgaccatcctagctagttaattttctgaagcaaagaatgaaagtgtagtagctaggaaagaaaaggcttggatggatgttgcaaagtggtttggaagggtgggtatatatatatgaatagatagacagttgaacttgaagtgggtagg

SEQ ID NO: 258 - DNA, 163 bp, Glycine max; identical to SEQ ID NO: 257
  Clone ID: 318O13_region_A3__217037_11

SEQ ID NO: 259 - DNA, 163 bp, Glycine max
  Clone ID: 318O13_region_A3__264929_68
agctaaagcaaaggtgggtttgtaaaatgtcaattgtttgtgcaaagcaattaagtccttttttataatatatatatatatatatatatatatatatatatatatatatatatatatatatatatatatatatatgataacaatgcataaagaacaatcacgc

SEQ ID NO: 260 - DNA, 164 bp, Glycine max
  Clone ID: 318O13_region_A3__55499_12
ttgctgcaaggtttcactctaattgcccccaaacgggccgcaagtactaccaccctccatccctctccgacaaccacggccaccactaccacgctggtgccaccaccaccagcgccggcggagtcaaagaggccgtggcggctaggagcattgacataattctt

SEQ ID NO: 261 - DNA, 165 bp, Glycine max
  Clone ID: 318O13_region_A3__295634_14
taagttcgttggtttgccttgatttgaaccacaaattttttaagtataatagtaattgattttttaaattttaaaatattattatatatgtcatgtataataataataatttaatataaatgaatagatgaacatgtttaaataaattgagtcggatttgacaaa

SEQ ID NO: 262 - DNA, 165 bp, Glycine max
  Clone ID: 318O13_region_A3__269358_15
ttcatgatggttaggtcttgtgcagcctcactatcaaagaagtacaccactctaaggtagtgaagcttcatggccaagtccaagccacccgggttgtggaatacgtccgacccggtggcccggcccggcccaactgaggatagcctcacatcatgcactacactc

SEQ ID NO: 263 - DNA, 165 bp, Glycine max
  Clone ID: 318O13_region_A3__457009_24
tgctgccattggagaaagttgttatattgagggagtttgctagctatagctgtgattgttttgctttgcttggttggtaaaggtggagagagagagagagagagagagaagtgtttagagaaaaaatggaaaattatattatggtgagttgagggaatagaagcc

SEQ ID NO: 264 - DNA, 165 bp, Glycine max
  Clone ID: 318O13_region_A3__176598_14
ttcactataaaggatccgttcagcaaacaccgctataattaatggcaatgcaatgcaagactaaacatcgaagatgagtgacacaataaaaatagttgacccaaaaagagcacctatgttctagtgaagaatacgactttttcttgttgccactctttaccaaca

SEQ ID NO: 265 - DNA, 167 bp, Glycine max
  Clone ID: 318O13_region_A3__278266_12
tcttaatggccaattgctgaaagtttgaatcaataattaaaagtacatacattcaaaataataataattaaaattacatatgatataaatgtgcattctgaattctaaggtgcaaaagaagaaaaaaatacttttaagctccatgttgactttgttatattaatggg

SEQ ID NO: 266 - DNA, 169 bp, Glycine max
  Clone ID: 318O13_region_A3__391810_12
aaggaggttggaggaaatcatcaaggggaatcttaggctaaacaatatttctaaaaccttggtttttaaccgtgtcgaatggcatcaagtgatccatgtagctgacctaacttagtaggataaagctttgttgttgttgaattgagaatcaaattgtgcacagtaagtg

SEQ ID NO: 267 - DNA, 169 bp, Glycine max
  Clone ID: 318O13_region_A3__269485_15
agcctcacatcatgcactacactctcttctaagaccattttttggtttgatcctagaaattaaaagagagagatatcacaaggtcaagagggtttggttgtgtgttgttgttgttgtaagaaagtgaatgcatatatatagaatgatgagtggtgtcataagtgaggga

SEQ ID NO: 268 - DNA, 169 bp, Glycine max
  Clone ID: 318O13_region_A3__359247_17
ggttgagaaggagagtttaagggttgaagggaggaggaggaggagggggagaggtcgtgggtttaaatcctcccactaacattctaacaaaaactagccactaaattgtctgacaaaaaaaatagcacttgtgatctatgatagtgtttgtatgacaattgggagtgaa

SEQ ID NO: 269 - DNA, 170 bp, Glycine max
  Clone ID: 318O13_region_A3__315094_13
tccatataatggacaggatatctgaattgcaaaaaaatcatgaatctcttgtttaaaaacagttttatttaaaacatttattttttattggaatgttttcaagatgataaatgagacaaatcaatcaatcagacttggtattaaaaacaaataatttcctcgtgacattt

SEQ ID NO: 270 - DNA, 170 bp, Glycine max
  Clone ID: 318O13_region_A3__307823_13
aaatgtcacgaggaaattatttgtttttaataccaagtctgattgattgatttgtctcatttatcatcttgaaaacattccaataaaaaataaatgttttaaataaaactgtttttaaacaagagattcatgatttttttgcaattcagatatcctgtccattatatgga

SEQ ID NO: 271 - DNA, 170 bp, Glycine max
  Clone ID: 318O13_region_A3__248588_15
gtctgcaagctaacagtgtcagaggatatgaatattagtattattaacaataataataataatgatgaaacgtgtctgctaatgagattgagtgtgatcttaattatttctttgttcatatactactgttcggcattttttttatcgtggtaatgactaagtgggaattc

SEQ ID NO: 272 - DNA, 171 bp, Glycine max
  Clone ID: 318O13_region_A3__252426_85
tcaattcaatgataaagtcctttggataatatatatatatatatatatatatatatatatatatatatatatatatatatatatatatatatatatatatatatatatatataagaaaacacattttcaagaatttttccactttatttcttgttctacctaagcaaacca

SEQ ID NO: 273 - DNA, 171 bp, Glycine max
  Clone ID: 318O13_region_A3__513314_16
cttaaagtgcgttatcgtcagcgtattactattctgaggggaaatcatgaaagtcgccaggtctgttcttttttaaatcatgaccttcctgttagtagtggattatagattagattagatttaaaatcctattttggtaatcggaggcatggtcatttggtcagtatcagt

SEQ ID NO: 274 - DNA, 172 bp, Glycine max
  Clone ID: 318O13_region_A3__68183_14
caccgtgaagatgatcaagagagagttcgagtatgttagtgcctactaaataaaacaaggggacaatattttctatgggttgggttggggttgttctccataaagaggaattgttgtttggggtgggtgggatttaggtttatagggttatccttgttggtgggctatccta

SEQ ID NO: 275 - DNA, 173 bp, Glycine max
  Clone ID: 318O13_region_A3__471191_13
cgtcacttgacctcaacaatgtgtatgctttaaatatccttctgctagcatctgctaggaccttctatttacacttggtattatgtaattggtaggttcgatgttgacatcttttacagtatataagtgttcatttatttatttagtcgtaccataatgagattaatttggca

SEQ ID NO: 276 - DNA, 174 bp, Glycine max
  Clone ID: 318O13_region_A3__163547_18
tttgcaaatcatgcatcctaagttttttaagtaaaataataattaaataataattttttcagtatcttaaaacatgaatcattaactttatatatatatatatatagattatacaaataagacttttacaaatgatgtaaaagattttactctgcaaatacacttgtgcattca

SEQ ID NO: 277 - DNA, 176 bp, Glycine max
  Clone ID: 318O13_region_A3__417867_15
gtttgggtctgaatctgaagaaacgctgcgtttcgtttcgtttgggaatgagtgacgatagaatggaagagtagtcgtagagtgtaagagaggattaaggaaatgaatgagagaaaaaagcaacaaaaactccgtccagtggggatcaggaatttcaccaactacgctagattcgc

SEQ ID NO: 278 - DNA, 178 bp, Glycine max
  Clone ID: 318O13_region_A3__332465_14
taacgctgcatgatttgagttctgttttgtcggcggggactagggacaaatatattttttgttagttaatttgtatatttattggtgatatgtctgaagttaagttaattggccatgcatgtgtgtgtgtgtggtagtgagaagaattgagaaaaagaatgtggtctccaaagtccaa

SEQ ID NO: 279 - DNA, 178 bp, Glycine max; identical to SEQ ID NO: 278
  Clone ID: 318O13_region_A3__207697_14

SEQ ID NO: 280 - DNA, 179 bp, Glycine max
  Clone ID: 318O13_region_A3__277229_43
caagccaacatacacagtggttctggccctgatggtactcgcttctctctctctctctctctctctctctctctctctctctctctatatatatatatatatatatatatatatatatatatatatatatatatattgtctgataataaaaaaaaatgttgtgcatgttcaatgacaga

SEQ ID NO: 281 - DNA, 179 bp, Glycine max
  Clone ID: 318O13_region_A3__36366_11
aattgtacggcagacacgtcctcgccgcggttaagaaagtgcgctctctctctcagagagtcgacggcgactacgacatgaggatggtgatggcttcgtttgtgggcaagctcagcttcaaggagatgtgcgttgtgctcaaggagcagaaggggtggaggcaagtcagagacttcttt

SEQ ID NO: 282 - DNA, 179 bp, Glycine max
  Clone ID: 318O13_region_A3__91970_12
tctttggacactgtgagaggtgtttataaatcgagagagagagaaatattaaagaaaaaaaagctaataaacgttttaaagagatatatatggtgaggtaattttgattttgattttgtttgtaccttaggttttttattgaattaaataatattgttaaggtcgaatagaatcatgga

SEQ ID NO: 283 - DNA, 180 bp, Glycine max
  Clone ID: 318O13_region_A3__211533_11
ggtgtgttgggagagtcaacagtctacttagacatgcggtacatacaccatatatttgaaagaaaaaaaagcgtagtcagaggaagcatgcgcgcatctacctacccacccttttcaattatgcatgtatatatatatctgagccactttgccacattcattcccaccctcatacccttt

SEQ ID NO: 284 - DNA, 180 bp, Glycine max; identical to SEQ ID NO: 283
  Clone ID: 318O13_region_A3__336301_11

SEQ ID NO: 285 - DNA, 180 bp, Glycine max
  Clone ID: 318O13_region_A3__441603_14
gtggtagtccgcaatgagacaatctggcttggtggttccatcacggatcgaactcatcgtcttcgagtgagtgagtgactgatcagggtctcaagctcttcatcgacccctcttctgattttctcgggaaaatgacgggagagaaggaaaatcgcgacttggtcttcgagaatggatgtt

SEQ ID NO: 286 - DNA, 180 bp, Glycine max
  Clone ID: 318O13_region_A3__468354_15
tttcttactgcacctagtccacgaccgtgtctaaacgattaaaagtgcaaaaaaaaaaaaaagttggccttatcaaaattaaactatcataatttatttatttattaccactaacactatatttattatatttattacaaacttaaatacatttacggtactttaaccgattattcaggc

SEQ ID NO: 287 - DNA, 181 bp, Glycine max
  Clone ID: 318O13_region_A3__188983_18
tgcgaattggtaacgatcttacttctcttttatatgctacaatacaaatcttgctttactaactcaattggaaacaagatctcatttataagattataaaaatgatttccttaggctaggactatatcctctctctctctctctctttttcttttttatcatcgcagaacttagatgaatt

SEQ ID NO: 288 - DNA, 181 bp, Glycine max
  Clone ID: 318O13_region_A3__115502_17
gttattggtcggtgtacctgatcgtgaggatgattattttattttatttttgggaagggaaggactatacatttattaattgtattatattcttttttatccctttttgaatcagaagtatatttatcgcatgtgccataaactttcttctgtgcccgttatgcatctgtgtcaactctcc

SEQ ID NO: 289 - DNA, 182 bp, Glycine max
  Clone ID: 318O13_region_A3__163006_13
tgatggtaatgaatcagatcaacgattttgggactgttgttgttgttccattttcagttttttattttgtttatgactagttgagtttgcaatcggttcttgctcggtgattttagaggttttggacatgattttagagtatgttgtattgtgtaaaactttgttgcaatctcgtgtggtta

SEQ ID NO: 290 - DNA, 183 bp, Glycine max
  Clone ID: 318O13_region_A3__119283_14
tgaagtggagtaaggtcttgtttgaaattattttttaatttcaaaacttgttttcaatataatttttagctttgttatattttaaaaataaaataaaaagaaaaaatatttgttaaaattcaaaaatagattttttttaaaaaaatgttcataaaatatcagcatctgtcaattgcatgttta

SEQ ID NO: 291 - DNA, 183 bp, Glycine max
  Clone ID: 318O13_region_A3__491126_11
cctctctaccaaacacaagcagaaaatggtaggaactcgagttggcaaatcgaaccttttatcaacacacacacaaaaagctgcaactaagaaatggagaaaaagttatacgattcaaaagagagaaaaaaaactattatgctgataaaaaaattggagtgaattggacttaccagtggagct

SEQ ID NO: 292 - DNA, 184 bp, Glycine max
  Clone ID: 318O13_region_A3__99512_21
tatatcgtgcatgtttgttggctctccttgacaagcatatctatttaatttatacaagtagtaaataaaatgataagactaaatgatgagttcacatatactttatttgtactcatatatatatatatatatataattcttggatggaaaggaccccgaagatacttccttgggtggtgacttg

SEQ ID NO: 293 - DNA, 185 bp, Glycine max
  Clone ID: 318O13_region_A3__280291_17
tgaaatcccaactataggttgacacctggccccctactaggctcaaacaaccccctgaaataccaaaaaacaggatcacgaatgaaacatgaaggaaggaaggaaggttagaactattacgactaaggtcagacaaaataaaggttgggagaaaatcccaaaatgaaatgttgggagaaagtccc

SEQ ID NO: 294 - DNA, 185 bp, Glycine max
  Clone ID: 318O13_region_A3__138443_19
tgataaagccaaagaagtaactttcgttcttattttcatgtgacttgtaacaagttacaagtcagtaatataacctataacttactcttcatcatctgcttcttcttttgatcataatatctgttaagtgatctttcatagagagagagagagagagatggagaggtgtgacaaggtgatgaacc

SEQ ID NO: 295 - DNA, 185 bp, Glycine max
  Clone ID: 318O13_region_A3__115973_14
ttaagcaattgagttggatgaggtggttagatagtctttatgtaaatactagtagttccaatatttaaatccttaacatggttggtaaagtctagataaggttttatacctccattttggaactaaaatcaagccttttatccttaccttacctttcggggaggaagcaccacttgaacaatcat

SEQ ID NO: 296 - DNA, 187 bp, Glycine max
  Clone ID: 318O13_region_A3__329977_14
cagagagtcgtgtttaagcatttgaaatattaaaataaaatgtttcaaagaatagtatattattataatttcgttttgacttatgaataatgcttcaaaacagagagttgtgtttattattattattctttctatttggaaatatctactaatggatcagaatagaatagatgtccttcggctttcc

SEQ ID NO: 297 - DNA, 187 bp, Glycine max; identical to SEQ ID NO: 296
  Clone ID: 318O13_region_A3__205203_14

SEQ ID NO: 298 - DNA, 188 bp, Glycine max
  Clone ID: 318O13_region_A3__153114_12
agttacaactttcgcatcggttacattttaaaggttatatatatatatatatatatatatatatatatatatatatataataataataatttatgaataaaaaaattatacagcaactagttgtcattattaataaatatagatgataataataatattgtagcttgttcctaaaccctctcctgaca

SEQ ID NO: 299 - DNA, 190 bp, Glycine max
  Clone ID: 318O13_region_A3__34581_13
gtacttgatcccagacaccacttgcgactgcgcctccaccacttcctcgaacgtcacttcctcctcctccttctgcgcctgcctcagcatccggttatgctcctccaccgagaaccgccctagatcctgcaccaccgccatcgctcaattgagattgatttagaacaatggagttacgtatacggtgtcg

SEQ ID NO: 300 - DNA, 191 bp, Glycine max
  Clone ID: 318O13_region_A3__292577_19
ccattgtaggaggacaagaatcacaagatctctctctctctctctctttcacatgaataaatagaagaaagagagaacaacaatctcaatatacacaaaactatgtatatctatatgtacatataatatataatatatgattttgggggaagtacttttttctttgtgtgttctgtgttgttgttgttgct

SEQ ID NO: 301 - DNA, 192 bp, Glycine max
  Clone ID: 318O13_region_A3__445391_20
tgcatttatcattgaattagagggattatttaccctaataataataataataatatggtagcggtgttgttggcatctgcattttctacccgagaaagcaaaaagcccaagcagtcgtcttggtgctgccgattggtcaaaatatataaatccatttgttgaaatttgttactgtattgcattgcgtttgct

SEQ ID NO: 302 - DNA, 192 bp, Glycine max
  Clone ID: 318O13_region_A3__350540_17
gggaagagtatttcaaaccgttcaacgtgagctacgatcaccgcgctctcatcctcaacggcaaacgccgcttcctcatctccgccggaatccactatccacgcgccactcccgaggtcaatttaatttaatttaactcatcatcagtcatcaactaaaataacactaacatgcaaccacaatttaactcaa

SEQ ID NO: 303 - DNA, 194 bp, Glycine max
  Clone ID: 318O13_region_A3__453879_15
gcagcactgaacatgataagagatcaaattgttaacttttagactccataaagtactaactataatttaagttatcaatgaaaagcattcccatggcttaacacaaaaatcagttcccaaaaactagtgtcttccactgaaaaacttatatttaaaaataaaataaaattgtcctttcttgttcttcaattgca

SEQ ID NO: 304 - DNA, 194 bp, Glycine max
  Clone ID: 318O13_region_A3__201246_13
tgtgtggaatgcacatttagagaagagaataaacaaaatattgagaatatctaattaagagaatgaaaaaaaaaagaatatcactctctaagttgtctattctaatttatattataggaataaataaataataaaaaagtccaattaaattaattcctaataaaatttagcatatcaatcaacatcatcttgcg

SEQ ID NO: 305 - DNA, 194 bp, Glycine max; identical to SEQ ID NO: 304
  Clone ID: 318O13_region_A3__326020_13

SEQ ID NO: 306 - DNA, 194 bp, Glycine max
  Clone ID: 318O13_region_A3__503801_14
atttgcattcagtgtgaacattgcttttgttttgtttgttaaatttaaacccctttctaactttcatcagttcagaataatgttttgcccaaaattgttgttttcagttgataccctcccctccaatgtcttacatttttcgctgattttattttatttccaatttgtctttcctcagattatgttaagtccca

SEQ ID NO: 307 - DNA, 199 bp, Glycine max
  Clone ID: 318O13_region_A3__302400_52
tacataaagaaccatgtgaggaaggcagggaaaaaggcaaaatagagtacactttaatttcaacctgaataggtaagaataaataagaaaaataaaaaggatttgtggttttgcacaatatatatatatatatatatatatatatatatatatatatatatatatatatggattcaacaaggctatcaatcaacagtca

SEQ ID NO: 308 - DNA, 200 bp, Glycine max
  Clone ID: 318O13_region_A3__448857_15
atgaactgttgttcctgtcatgtggtaagtttaggttgattaacagtaatggattaccccatctgtgtattagtatattcttgaattgaagtttacgttattaaatgtaaaaataaaataaaattctaggctgttaaaagtattttggaaagtgttattgttttcttttctaaattgtatccaaggtggtttgagggttt

SEQ ID NO: 309 - DNA, 204 bp, Glycine max
  Clone ID: 318O13_region_A3__48364_14
aacaagtcaccaaggcacaactttaccgctgcaccaggactcgccctccgaagaaacatatatattgatgtaaataattgcagaaataaaatacccgcaaaattatttttgtccaaaaatacagaaaaaaaaaagaagaagaagaaatcacttctttttcttaagttgtttaacatttttggaattggcttgttctctggtctt

SEQ ID NO: 310 - DNA, 205 bp, Glycine max
  Clone ID: 318O13_region_A3__251804_48
tgttatcaatcgacgcaataatcaagaaaatcaaacatggtatcagtaattaattttaaataagattatatatatatatatatatatatatatatatatatatatatatatatagacaccccaataaaaatcatattaaaacaattataattcataatattcagaataaataaaaatattgaaataaatggcaacacctcatcgt

SEQ ID NO: 311 - DNA, 205 bp, Glycine max
  Clone ID: 318O13_region_A3__382583_13
ccctctatcaagtgtatcagcccttataaataccatgaatgaatgaaataaagcaaggaaaaagtttatcagtatattcttatagcagtagcagtagaattagctaagtatagaagttcaccctatcagtagctatgtaacctagtacttacttacattatccaattacttggtagttttcctgatagaaatggtgtactttcct

SEQ ID NO: 312 - DNA, 206 bp, Glycine max
  Clone ID: 318O13_region_A3__124737_14
tccaattagttgcagaaacaagcaagccttccaattagttacaacaacaaccaaacattttcctactaagtggggtcaactgcatatgtatttcacaataaataaataaaaaatacttaccaatatatttatttatttctacattttaaatttaaaattaggacatttgctcaacacaaattgtgtattggcaccaaagaggacta

SEQ ID NO: 313 - DNA, 206 bp, Glycine max; identical to SEQ ID NO: 312
  Clone ID: 318O13_region_A3__124766_13

SEQ ID NO: 314 - DNA, 209 bp, Glycine max
  Clone ID: 318O13_region_A3__461351_16
gaatggtgttagggttgaagcaactgccaccgggttgaattgccctgcagtcagctccatgtgagcatgcaaaggccaaccctgacttcagtgccccgtagccagcgttgctccttgcctcgcaccacaatgttcatcatcatcatcatgctcccaactactattaacactagagaaaccacttttgctgcccttcaacaaattactat

SEQ ID NO: 315 - DNA, 214 bp, Glycine max
  Clone ID: 318O13_region_A3__64953_19
caccttgagaaacttgaaacacttgaaaagaaaaaacacagacacaacttccaaaaccagacaccccagaaagacaaaaacttttcataagaaaagcaccaaagtaacaaaataatataataacataataatggaatatggaaaggaaaagagagagaagaagaggaagaagaaaggggggaaaagaggatgagggcagtgaccctttaaagag

SEQ ID NO: 316 - DNA, 215 bp, Glycine max
  Clone ID: 318O13_region_A3__366586_13
tgtccatgcattaaagcaaacatctagaattagaacttcatgcactttatctattaaatctttgcaaaagtatttgggagatagatagataagataggtttgtcgtgattttcagggacaagtattccaatagatgtcggtagaaaaaaatcatcaaattgataaagaaaaatctaaaatcatacatcttagacaaataacgcatgtttgcattc

SEQ ID NO: 317 - DNA, 217 bp, Glycine max
  Clone ID: 318O13_region_A3__46190_15
caaacctccaatcactaaattgatcctaatcaatttttcagcaaagaacaatattacttatttcatcctgttaaatcttagtatctatcagcataaagaattttataatgtcattcaattaaaatcctctctataaaaaaatcaataattcacctctaaaaaaaaacaaaagtgaatcatgaatgaatgaatgtgtaccttggcctagcctgaactt

SEQ ID NO: 318 - DNA, 220 bp, Glycine max
  Clone ID: 318O13_region_A3__81016_11
cctcggccaaacataactagtctaacagttttgtttgtatctataattattgtgtaaatgattgtacttagagatccctcttcatgaaaagagagagagatgcccagactcctaaaaatatctaaaatgcaataaaaatgattgtttgttgtttgcatttaaaaaacagcaaaacctttcgtgctaaaataaacttaccaaacaagatggaatcaaggct

SEQ ID NO: 319 - DNA, 222 bp, Glycine max
  Clone ID: 318O13_region_A3__134426_14
ttacactatgggtccgttcggttataactttttaattcttatattaaatatattatctttaaaagactactgatgaggataaatacataaaaaaaaatagttattttaccatctaaaaacattgttccattgagtacacttcaaatttagagaaaggaaaattgagttgaaataatgaaatgaaatggatcataatccatcatcatcttccattatgtttca

SEQ ID NO: 320 - DNA, 223 bp, Glycine max
  Clone ID: 318O13_region_A3__292724_14
ccattgtaggaggacaagaatcacaagatctctctctctctctctctttcacatgaataaatagaagaaagagagaacaacaatctcaatatacacaaaactatgtatatctatatgtacatataatatataatatatgattttgggggaagtacttttttctttgtgtgttctgtgttgttgttgttgctatggtatgctattcacaaagcaagagccgtta

SEQ ID NO: 321 - DNA, 225 bp, Glycine max
  Clone ID: 318O13_region_A3__187096_17
gtccagccaaatgcgtaacatttattctgatgtaaaaaattattattattattatagataataaaatcttgttcctgaacaataaccatcaatgtaattataaaattgaatcttagactcaaaactagttattaatctggaacaatgtttactcaaaactagttattaatagtatttttaagttaatttgaaatttttttttcggcgttaaacaaatactagatg

SEQ ID NO: 322 - DNA, 228 bp, Glycine max
  Clone ID: 318O13_region_A3__381693_13
ttgatgttatgattcaatggtttgatatgtttcttagaaagaaagaaaaaattgttgtaaattttagtacagtttgatactaaaactataatagtaaaatttataataaactagaaaatatactggatcttgtgttttcttactatttatgtcagacattgtcagcctgcaaaatgaagatggatccttttcaggggatatgtggggtgaagttgatacgcggtattt

SEQ ID NO: 323 - DNA, 229 bp, Glycine max
  Clone ID: 318O13_region_A3__361286_33
actccagttgcattctcttcgtaaataaaccagtgtagttagtataaatattgtaagtacttaagccaaacatttgtgtattttcattcaataggttctctcattctctctattgtgtgtgtgtgtgtgtgtgtgtgtgtgtgtgttctgtgatatggattcttatttctggtattttggctctttaacctttaaaataattagggtaagcaacaaagaacacatttca

SEQ ID NO: 324 - DNA, 230 bp, Glycine max
  Clone ID: 318O13_region_A3__482668_14
cgtttgttacttcacacgcacacataaaaaaaaagtgtgattatttctttgttaaaatttatctaaaagcattcaataaattaaattaaacaatcatttttcttaatatagcagcaatcttagtatagaattgaagttaaaaaaagtcccttaataagggaaaatacaattgcacaacaaataattctctaaccaatcaaattttatggcacacttgtacgtaagtctga

SEQ ID NO: 325 - DNA, 231 bp, Glycine max
  Clone ID: 318O13_region_A3__128002_12
cttgccagggatcaaatcataaagaaatatttaccagtcaaaaaagtcagaaatggagatgcataacaatgttaaagttagacaagtaaataccccatataaaatatttactagaattctagagagagagaggctgaatctgttttctgttattgattgatgaatcacttattactatctgatggaagatgagttttatataatagagttaccttgtcctgcaagcttaca

SEQ ID NO: 326 - DNA, 239 bp, Glycine max
  Clone ID: 318O13_region_A3__499270_14
cactgtgtaagtgtcccttgcatctccctgctttattttgactgtaatgtgttgaattgtttatagtttctttactttcaatgccaatatatatatatatgcttataatcttctgtcaaaatgcttctaaatctatgtattttatgactttgttaactatataaaacatttctaattattatcatgaatctgacaattaattatacagatcagaaaacgagtcttctgattcaaatccc

SEQ ID NO: 327 - DNA, 242 bp, Glycine max
  Clone ID: 318O13_region_A3__231650_12
cttcaaggctttggagaacaaacatgacaagggaggaggaggaggaggaggagggagcgttgctgaatccgacagcgactccgaggaggaggagtacgaggacctggcccacaagcccattggccccgtggacccctccaagtgcaccgccgccgggaccgggatcgccggcggaaccgcgtgcgctccgtcctcctttgtggtggtggccaaggacgccgatgagaggaaggtttccggtg

SEQ ID NO: 328 - DNA, 251 bp, Glycine max
  Clone ID: 318O13_region_A3__199851_13
cggccatagtcatatttatgcttccaaaaggccactacttggatgaaaacctccacttaatttaaagaccaattttctaaaaccatgcgtttatttatttataaaacccctacgcggtaaaaataaataaaaattgctagattttgattctgccttctgaaaaaggaagtgcacattagcatattaattaaatattttcttccttctattttatttgatattaaactcactaatagcgtgattggaaccct

SEQ ID NO: 329 - DNA, 251 bp, Glycine max; identical to SEQ ID NO: 328
  Clone ID: 318O13_region_A3__324629_13

SEQ ID NO: 330 - DNA, 266 bp, Glycine max
  Clone ID: 318O13_region_A3__374190_19
agccaaggtaaggcacacaaacttgcccccaggctttaaaactctcttcacctgaaaataaaaaataaaataaaataaaaaataaaaaagccaagttaccaaaaatacaaaatagtcaatccatataaacattcattatttagatcttgtttgtataaacttctatataaaaacttttagggggaagtaaaaagtaaaatacattgagcttctcttataagttaaaagcaggctagacagatttctattatcaccggattggatga

SEQ ID NO: 331 - DNA, 266 bp, Glycine max
  Clone ID: 318O13_region_A3__460603_13
cacgcaaccattcatgttacaaagttgtttttataatcgaaagaggaaactaagaaaaattactttcatgtaagttataagttagtttcataaactgtattaatgaggttattataattaataaactgacaacagagtataaattaaaatatctttatttatttatagaaattctctcaatacaaatgtttgtatcataaaataacataacaggtagatcattcctctgatgttattgagattagcttgggcagtattcaatcctc

SEQ ID NO: 332 - DNA, 268 bp, Glycine max
  Clone ID: 318O13_region_A3__108681_14
aagagtgtgaaattggtacgacagttattaagtcatgtggataatgaaattaagagtaacatttatgaaaatattatattgagcaagttataaacataatcactaaaactcatcataagaaaaaaaacatgattagtcttgacacataagataaacattaatttaatttaaaaaacaaagaaaaaagtgtagaggggagacatatatttgacattttttatttcaaaagaataagagaaatatatatggtgcttgcatcttgatgaac

SEQ ID NO: 333 - DNA, 269 bp, Glycine max
  Clone ID: 318O13_region_A3__459791_47
tgcttatgtcagctacggtcaatctttgatttttttaatagagaaacattttttttacatctattattgagtgaaccttataataatttattctttgacatttattattgagtgaactaaatgtaaatgtcataaagagttactgaataagaatatatatatatatatatatatatatatatatatatatatatatataatatacattcttaacatttaatgttcaacaagttaactgaataataatagaggtacctactcgcctcgga

SEQ ID NO: 334 - DNA, 279 bp, Glycine max
  Clone ID: 318O13_region_A3__4257_20
tcccaacgcaacagtaacgtaaatatttgaagtgaaactatactcttaaatcaaatgtactagtaactgtcacaaaatttaattcatatatatatatatatatatgcataataataatttctctcatgcataagttttattcttaattattttttttcataaattactttatgtttcactatatattttagaaaaaaatgatattaaaaaagttaaattctaaaataaaataagacttgctaaataaaaagattagggagtggttacattcaagtttca

SEQ ID NO: 335 - DNA, 288 bp, Glycine max
  Clone ID: 318O13_region_A3__238810_14
caggtgttaatactcctttcatttcaaaatattgatcgttctagattttttttaactggagttgttctagatatttttatccaaactaagaaaatataataaatagataaaagaaaacagtaatttgataaaatcaattttattattattttacaagcaaaaaaataagtaatgttatgttaaaaaattaaaacaataattattttgaaacttatttttgttttacacgataattaatgaagagaattatatatatatataaacgtcatcattggatagaaacgatgt

SEQ ID NO: 336 - DNA, 289 bp, Glycine max
  Clone ID: 318O13_region_A3__245817_14
atcataaattcattcaaacacatgctaaaataaaagtttaaatactttttagtccttaatttagcttttttgtttttgtttttgttttcgttcttataaacattttttgttttgttttaatctttttaaattttttttattttatttttcatcctcaaaatgatttagataacaaagaaaaaaatattaaattacaagaaacaaaaaaatatataaacctaaaataaatataagagtaaaagatatttatttatttagctaaattgatctaaacacgcagaatggtagt

SEQ ID NO: 337 - DNA, 289 bp, Glycine max; identical to SEQ ID NO: 336
  Clone ID: 318O13_region_A3__245956_14

SEQ ID NO: 338 - DNA, 289 bp, Glycine max
  Clone ID: 318O13_region_A3__74148_14
tgcatgcatgtaaccagaaataataataacaattaacaacatgcatgcatgcataccggcttttttcataaaaaaaaatgtttttacgtccgtccaaattattttattttatatttcggccttttagtttgtgattgattttgattaactataaaataaattaatttcaacacctattcagtgtactttgtacacttatgttaatttattttagagattttctttttctacaatttcttaagtgagttaaaaaaatgttgattatttcttcatacactcttgcagtgtg

SEQ ID NO: 339 - DNA, 289 bp, Glycine max; identical to SEQ ID NO: 338
  Clone ID: 318O13_region_A3__74089_15

SEQ ID NO: 340 - DNA, 296 bp, Glycine max
  Clone ID: 318O13_region_A3__241686_12
tggatcaaatggtacttgtcaactgttttcttttttaaaaaaatagcaggtatttgtcaacagtaagaagtatatagtctacatgtcaaaaagagtttacatataaaggattaggtataacaacttttaagaataataaaagatgtaacttatagaaatggtttttctataactattaaaaacaactttttaaatagttataaaaaagtggacttaattattattattttaaggagaactcttttttttaccaatttaaggaggacttaactgatgttaataatgtgggcaaatgg

SEQ ID NO: 341 - DNA, 298 bp, Glycine max
  Clone ID: 318O13_region_A3__47476_12
tttgcagcaacatatctggactttcttttttaccggtagaaaaatttcacatgtttttaattaaactaagatataactttaatcttcttattttgttaattcactattttttatctaatttaaaattgagacgtttagttttcaggtttcgaaaatctctaattttagttcgatcttgaattttgtcttcatttaatattattattataagagaccaaaacacaaataatatatgtatttaaacctttattttatgatcaaaatatatgtttgcaaacctgggcacataatggaacac

SEQ ID NO: 342 - DNA, 299 bp, Glycine max
  Clone ID: 318O13_region_A3__164550_12
caacataatcctaatctcccatgcttaaatttacccctatattcttataagaaaaaaatcacccgcatatttttttcccaggtcatagatcaatgtataactatggttggtgtaaaaaagttttataactgatgaaaatatcaaatatttctcccgctacatatttttatttacctgaactcaacaaaacaaaaccttacgtatgagtttaaatgtactaatcgactagagagagagaggaaaaaaaaagataaaaatagaaataaatagacatttttattcccggaggaccatatgtc

SEQ ID NO: 343 - DNA, 300 bp, Glycine max
  Clone ID: 318O13_region_A3__101255_15
gcactaattaagcctgtttcaacctgtaaaaaaaagtctgtttcaaaattattttttatgcattttacttaaaaaaattagacctaatgaattttgaatattgatttgatttttttaagagaatatatttttgagttatatatatatatattagtagtcctacctcgttctaatattttatatttttttaataaaatatacaaatttttaaacaattttgtattaaggaaaaattaatcattttattcttataattatacaaaatttagctttgaatgaccacatttaattagtccatga

SEQ ID NO: 344 - DNA, 101 bp, Glycine max
  Clone ID: 515O02_region_G2__16189_11
ttccacaaatccaaattccaaattcatgttctaacctctaacaactatatatatattccttgtcatttgatgagtatgctttgatttcctatggaatctca

SEQ ID NO: 345 - DNA, 108 bp, Glycine max
  Clone ID: 515O02_region_G2__71925_13
tccgactttgtggctatatatgtgtgtgtttttgttcatgttgtatttctttctttctgcaaaccatatagcagtataagtgttttgtaatgtacatcgggcacaact

SEQ ID NO: 346 - DNA, 110 bp, Glycine max
  Clone ID: 515O02_region_G2__4707_12
caagatcaagcacccttgtttctcttttttggattttattgcaggttttgttgttgttgaatcgtatttctgttgcatcattttttacacgctactgtctgtaatggaaa

SEQ ID NO: 347 - DNA, 111 bp, Glycine max
  Clone ID: 515O02_region_G2__118904_18
tagctgcatcacctctcagtttctgttagtttagccaaatgcatgtatataggacaaatatatatatatatatattagctaaattgaaatcagggctacatttaaggacaa

SEQ ID NO: 348 - DNA, 132 bp, Glycine max
  Clone ID: 515O02_region_G2__13655_17
gagtcaatttccttaaacccatcacatacaatcaaattcaaaatgtgtgttgttaactcattggcaagtggactaaattgtcacaagtaataaaataaaataaaagtctgagtatcaagtccacaggagctt

SEQ ID NO: 349 - DNA, 143 bp, Glycine max
  Clone ID: 515O02_region_G2__53900_13
atttcttcacatcgtcatcccaaacccaaaatctatagttcttaactttctacaatcacaaacaaacaaaagcaatttaaaaccatagaatagaacacaacacccaataaagagcataaatccttacattccaccaagcacat

SEQ ID NO: 350 - DNA, 145 bp, Glycine max
  Clone ID: 515O02_region_G2__8079_14
gtgagagttaagctgggaacctttggcaactcttgcgaactgtctcagaaaagaataataaataaataaagccatcaaagagaccagaaaattctaccaattaggaaatcatgcaccaacgcaagagggaagagagacagagatc

SEQ ID NO: 351 - DNA, 146 bp, Glycine max
  Clone ID: 515O02_region_G2__9969_28
tcaccagagacgcattatcagattcaaaccgaagaaaagggagcaattagggattattattattattattattattattaccagccgaagtcgttgccgagcgacatcgttttgctaccgtgagaaggaaacagtagctggtagcg

SEQ ID NO: 352 - DNA, 147 bp, Glycine max
  Clone ID: 515O02_region_G2__72308_77
tttcttaaacagatcactggtatgcaaaatccatactatatatatatatatatatatatatatatatatatatatatatatatatatatatatatatatatatatatatatatgataagaacctcctcccttactactccctatgca

SEQ ID NO: 353 - DNA, 147 bp, Glycine max
  Clone ID: 515O02_region_G2__99475_19
tgcacaatgagatttgaagtcatgtaacgatcaacaaataacaagaataatataatcaatcatgtaaaataataataataataatagaaatcaagaacaagtatgtccaaaaaatttagggagggtaatcgaagattcctgactcaa

SEQ ID NO: 354 - DNA, 147 bp, Glycine max
  Clone ID: 515O02_region_G2__118615_18
atcatggatctgattccacctgaaaacacaattcagcacaactgagaattctgtattgccacaaacttaattttagtttagaacttatttttacttagatctttatatatatatatatatacaacttagcgcccatacatacaatca

SEQ ID NO: 355 - DNA, 149 bp, Glycine max
  Clone ID: 515O02_region_G2__119001_46
tgaaatcagggctacatttaaggacaaatatatatatatatatatatatatatatatatatatatatatagatagatagatagatagatagatagatagatagatagatagatagacatgtacagcataatcaagttgaccaaatgcct

SEQ ID NO: 356 - DNA, 149 bp, Glycine max; identical to SEQ ID NO: 355
  Clone ID: 515O02_region_G2__118958_43

SEQ ID NO: 357 - DNA, 149 bp, Glycine max
  Clone ID: 515O02_region_G2__17197_13
cggagtcggagtagtcgagtagacatagtggggggcgatatcgcgataggatttatcctctgggaggaataattaattaattggtaatatattattttttttataatattaatttattatataaaggtttcatcggactcggtattatg

SEQ ID NO: 358 - DNA, 150 bp, Glycine max
  Clone ID: 515O02_region_G2__105163_29
ttccaattccttagcctatcaaacatctaatctaacatagagacgtaaggatctgccaattctgatcataacaatcaacgcaagtattcgatttcaataataataataataataataataataagatgggaatgcataggtacaaatgtt

SEQ ID NO: 359 - DNA, 151 bp, Glycine max
  Clone ID: 515O02_region_G2__111335_13
atacttacaatccgtcaggcagctcgatgcttgcttgctttgggggaatatttccaacgcctgagggctttgagctcactgtggtctaatagacctcgtgaacctgcttagtctcacaacaaggttacaagagcgcaaactcataacatga

SEQ ID NO: 360 - DNA, 152 bp, Glycine max
  Clone ID: 515O02_region_G2__106396_13
ctgtcaagggaggaaattggtacagatcaaagtttggttgtactttgccaactaaatattatgacatcaatagatacttagatagatagatgcctttatttatctttgttttgaactactatgattactggtactttcttctggcagttgtt

SEQ ID NO: 361 - DNA, 152 bp, Glycine max
  Clone ID: 515O02_region_G2__59229_17
gcttgtcaggagagaaatgttgcttaaaaagaaaagaaaagaatgaacgacgctaaaactagattgtatgtgaatgatagacagaagaatattaatattgtaaaattgacctctttaagattgacccactcccatgtttcatttgctgaatt

SEQ ID NO: 362 - DNA, 153 bp, Glycine max
  Clone ID: 515O02_region_G2__73795_20
tggcaacacttaatttgcacagataactctctctctctctctctctgaattacccaatgtcttcaacatatttatagtagtactatatagttaaaacaaaaccacctaattattttttctttttagaaaagggtttaatttgttattcttccc

SEQ ID NO: 363 - DNA, 153 bp, Glycine max
  Clone ID: 515O02_region_G2__85664_20
tgtcaatcaataaccattgatctccttacctattcttaatttagtttttataatatagagcatttctaattgtatcgctatatatatatatatatataaataattgtatcgctataatttattcttaatttggtacccgtaaatagaaaccaa

SEQ ID NO: 364 - DNA, 154 bp, Glycine max
  Clone ID: 515O02_region_G2__36921_17
ccgagacccacttggtattacttcagggttccctcacggaacggaacaaaaggcgcacacaatcgccaaagagaaaaagaaccctcaaccaaacaacaacaacaacaaaaaaaaagccctagaaaagattttggagaagcaatttctcactcct

SEQ ID NO: 365 - DNA, 155 bp, Glycine max
  Clone ID: 515O02_region_G2__124150_19
aagtggttgcacacagcatctaggaaaaaagtcaaaaagcaacgctggattagaacaaaatataattattgtttatttttctttctttctttctttttcattttttaatgacatctttttccattgttgtaatggcagaaatcagtgttcagtga

SEQ ID NO: 366 - DNA, 158 bp, Glycine max
  Clone ID: 515O02_region_G2__5089_14
tcatacctgaaatatgggtgtcttcaaattattagctaatatttattttttttaatcaagtagttgaaaaaaaaattcagtttcattttattatttatttatttttcatcaagtggtaatatgacatacggagtgttgcctcaacctgtcttgttatg

SEQ ID NO: 367 - DNA, 158 bp, Glycine max
  Clone ID: 515O02_region_G2__58221_15
catttcaaagggagagccatcatcattttattttattttttgatatagagagccatcattattgttgaaactaaagatttctcataacataaagttgtatactaagaaaatgattgatattcacttttagcattttctttgctttctccatttccatg

SEQ ID NO: 368 - DNA, 161 bp, Glycine max
  Clone ID: 515O02_region_G2__96139_14
ccctcaagccaatgatagtaactccaaagtcaaaaagttcagtattttttttttttttcattttttcgtcagcttgaatgacacttggatttagacaaaggttttttcataataattataataataataattttcacgtaaggttgagcataggacgagtt

SEQ ID NO: 369 - DNA, 163 bp, Glycine max
  Clone ID: 515O02_region_G2__70595_13
ttgggaactgtacacatgccttaatataatattattttattatattatatatgagtatttatatttttttaatgtgatggaaaaaagaagataagaagaaaaatcaggtgagatgatacaagaatatatatatataataattccaaatgaaataccacaaaca

SEQ ID NO: 370 - DNA, 166 bp, Glycine max
  Clone ID: 515O02_region_G2__4340_15
aaatatgggtacatcatccgatacaattactaaactaaactaagggaagaattattctcacttttatatttgttatttaaactatcaattctgaaatttctattttgcccactaaccaaattcctccaccccctctcttttcccttccctccttctcatatccaaa

SEQ ID NO: 371 - DNA, 169 bp, Glycine max
  Clone ID: 515O02_region_G2__90417_11
aaactgcaaacacaaattgcctaaaataaaattgacaaacatgtaaactcttttcatcaccgaatagggtaatgggtagccaagagagagagataactgaagggtaagaatcagcagaaatcatcagaaaggatatgaaatgttaccaagtcaagtacaggctaccagg

SEQ ID NO: 372 - DNA, 169 bp, Glycine max
  Clone ID: 515O02_region_G2__49711_17
caaagagaggcagaggaggtgattagattagtgtcaacttgttgctatgccaacaatgacaacccaacccaacccatctagagtacaaaacaaaggcaagacttttatgccagcttttcctatatctagagtagtactcctacaatcaaatgacaagcagctacaacca

SEQ ID NO: 373 - DNA, 169 bp, Glycine max
  Clone ID: 515O02_region_G2__63053_13
tgtgcataactcgatctcttgatgatttctaccaattggcctcggccttatatatatatattctcattctcatatatatatatatgtgcgtgtagtttacatgaattttgcaggtgattattatttgaaagcaaatttatttatgctgttagtaaagattgcagcaaga

SEQ ID NO: 374 - DNA, 169 bp, Glycine max; identical to SEQ ID NO: 373
  Clone ID: 515O02_region_G2__63076_14

SEQ ID NO: 375 - DNA, 171 bp, Glycine max
  Clone ID: 515O02_region_G2__44442_12
aacgcgtctttctttcttcttcaactaatttgcattaaaagtatcctcaagtaactaagaaagcaatcaagaaagaaagcttcttgtattcattcattcattcattatgtgtgtgtgtgcgagtacaaaatttatttctggaatctgaggtgtttcatatagccatgttgc

SEQ ID NO: 376 - DNA, 171 bp, Glycine max; identical to SEQ ID NO: 375
  Clone ID: 515O02_region_G2__44422_19

SEQ ID NO: 377 - DNA, 178 bp, Glycine max
  Clone ID: 515O02_region_G2__44158_19
tttcattacgtgcgtttgtacaactactatgaaacaaacatgaaaaatgcacaatttactcgtagaaataataataataataaaaataaataaataaataaaataaagtattttttgaaaaataaaagattgttagtactagttactacggagtatcgtattcgtatcatccaccctg

SEQ ID NO: 378 - DNA, 178 bp, Glycine max; identical to SEQ ID NO: 377
  Clone ID: 515O02_region_G2__44141_17

SEQ ID NO: 379 - DNA, 178 bp, Glycine max
  Clone ID: 515O02_region_G2__90762_17
ccagagatatgattcaatacaaaggaaattaagtaaacactaactcaacattctaaattttctttacttttctctattaatatttttttaaaaagaaaattcttctcacatatacaaagagtcttgagggagggagggagggcaatgcccccccttgaatccgttaccacagggtaat

SEQ ID NO: 380 - DNA, 182 bp, Glycine max
  Clone ID: 515O02_region_G2__106241_14
tagatagctagccatgttggcatgaagatttgagcgggaaaataataagacaacatacataacgttttctcaaagtggtttttttattttattttttttatcataaggtttggctttttagttttttatttttcagtttttgtggataattctattaactgtcaagggaggaaattggtaca

SEQ ID NO: 381 - DNA, 185 bp, Glycine max
  Clone ID: 515O02_region_G2__109676_12
tcattgtctttgaggactttctcattattattggattttaatcaataacttcttctactgtcttcttgagagagagagatgggggaaatttgaaactgcattcatttattacagttttaatacattatgcaagatttactcaaatgctttttgtacttaaaatggctatcactcagtgtcagtga

SEQ ID NO: 382 - DNA, 185 bp, Glycine max
  Clone ID: 515O02_region_G2__86242_14
ccacaactccgatttatcccataacaataagtaaataataagtaaaatggacatgagttttagcaaaaaaaaatagaaaaactaagcatactaaaacattatcattttaagaaagaaagaaaaaagactatcataactgattaggatcataaaatttcctgaaactccaaatttcttctttgtgc

SEQ ID NO: 383 - DNA, 186 bp, Glycine max
  Clone ID: 515O02_region_G2__83109_12
tcaccctttaggagatcctagacacttatggaaaagtatcaagacaacttatcaattttcaaaagtctgaaatctttttgagttcgattattcaacaacaacaaagacacaaaatctcttcctaggtgtcactaaaagcattggatccaacaaatatttaggacttccttcaatcattggcaagag

SEQ ID NO: 384 - DNA, 192 bp, Glycine max
  Clone ID: 515O02_region_G2__10461_15
ggctgtgtgtgagtgagagtgagagtgagagtgagggtggataaaacaaacaaacaaaactagcgcattttgttgcgggtggaattagactgttactaagtgcttaattaatggggaaaggaaagtggtatgattagtgtttgtaacagtaagtgattattgtaaatgatgattaggaggaataagggtgca

SEQ ID NO: 385 - DNA, 194 bp, Glycine max
  Clone ID: 515O02_region_G2__67608_15
ggtggttagatccaatttcatgttgaatttaatattgtggaacaaaaaggcggtgttatatatatatatatgatggtcgatggtgcaagaggggatcggaagattatacttaaagaagcagaagcatacttgtactccaatctaataaaaatgttctatatataatagaaaatacggatacgtgctgtacagga

SEQ ID NO: 386 - DNA, 200 bp, Glycine max
  Clone ID: 515O02_region_G2__63275_46
tgctgttagtaaagattgcagcaagattttgccataattaaaaatctactttaaccccattgccctgcatgtacattttattattagtttgtttgatgattttggaattttgtggtttaatttattaatatatatatatatatatatatatatatatatatatatgtatatattttgaaggaattgaggagcggagtata

SEQ ID NO: 387 - DNA, 203 bp, Glycine max
  Clone ID: 515O02_region_G2__62405_14
tgcatagagagaaatagacgaggaaaaatataaaagaaaagaaaaaaattataaataaaacaaacaacataataaaaaatgaaaagaagaatagaaggaaaaatagactcaaaatgagattttgaaattatataattaataatccaattaatctcatgagatattattctataactataacttatggaccgtttggaagagat

SEQ ID NO: 388 - DNA, 211 bp, Glycine max
  Clone ID: 515O02_region_G2__33563_12
ccttaggtgctcatacatccaaacacttacacacttgttttagtaaataatgttatattctatctcaaataaatccaatgtttagaataaatccttgattgacttattattattaatatgctcatttataaattattgtcaaagataattttgttgaacaaattttttaaatatttacaaaatatacgtttcttgcgttgtatatgaatca

SEQ ID NO: 389 - DNA, 243 bp, Glycine max
  Clone ID: 515O02_region_G2__33146_14
cgaaccctaaacatttcaaaccaaattactcacagatatagtttttttcaaaaattgattgagagatcgtgtagaaaaagtaaatttcaagcaaaactcatcctcaatatcctttttgtattggtttataaacatgagagaattgggaaaacgcttttgttttttgatccattctcacatctgcgattttgcttctttttctttctttcttccatgtatgtgtttccaacctttcttctgaaa

SEQ ID NO: 390 - DNA, 251 bp, Glycine max
  Clone ID: 515O02_region_G2__102179_29
aatctcgattgtcttcttgcgaaattgatttccatcgatttctctctattttttcttttctaaattatattgacaactatatatatatatatatatatatatatattatgtaacaaattttatgatgcagttagataacaagaatcaaacaataaaaatatataaaaataagcttaagtaattaatatccctaaaattaaatcagataaattaaaatggtttgtatattgcttgattgttgacttgttgga

SEQ ID NO: 391 - DNA, 257 bp, Glycine max
  Clone ID: 515O02_region_G2__2646_15
ccaaaggcttagtttcatttgcattaacatattaataataattcacaagagaagaaatataaaataagataaatcaattttttcacaagttaaattttattttattttttggaatttttacaagaaataaaaaaattcataacttaaaattaactcatgtatgataactttttaatagtttttttgtttaattttcctaaaagataaggcgtataaattaattttagtttacgagagaagttggatttgtttatttc

SEQ ID NO: 392 - DNA, 269 bp, Glycine max
  Clone ID: 515O02_region_G2__76652_24
actaactcttgcgtgctccttgtttcaaacaattaaattaatataagggtatttgttagtgtttaggatattggttaagaaatcaatatatatatatatatatatatattgtataaattataagagaatataaaaaaattatgaatagtataattttttgtttttcaatttttaaaattttaattaaaggaaaattggttatatttaaaattattctttatgtagaagaaaaattgataaatgattttgatccagtatatgtcccaggg

SEQ ID NO: 393 - DNA, 283 bp, Glycine max
  Clone ID: 515O02_region_G2__66280_14
gtgttagattgattaaagttcgctgatataacttttatttaatgaaaattaaattgttagtacaaatattgcaagtctttattaataatacaatacatcatactaacatatccaaaatatttatactaattaacagttcaatcctgctagataaatgcttttctatatatacactgacagaacagttttaatgcttttttaattttttcctgtttgtaataatgattttttgtttgtttgttagaaattgacatttttttcactttaatcatgggctaaatct

SEQ ID NO: 394 - DNA, 284 bp, Glycine max
  Clone ID: 515O02_region_G2__54768_13
aaattaccaatcatgtatggagtgagaaaacctcgagcatatgagaaaggggtatatgaatatactactattcgtattattatcaaatattaatatgttccatagaaatttacaaattatttatattctattattattatttagtaatagtagtatagtattagtaatgacattggatcgtaaatgtaaattaaatattatatcattagtatttgtaggaatgtaaaatttaatttaaatgaaaaatattatatgacaaaagttatggtgcaatattgtgcctg

SEQ ID NO: 395 - DNA, 289 bp, Glycine max
  Clone ID: 515O02_region_G2__62580_14
aacttatggaccgtttggaagagataaaaaaagaaaagaaaatattgattacaatatatttttctttgtttaattgaagaaaaataaagaaacaattgacttctaagaataaaaattcaaaacttttcttatgttttaacttttttttaatttcaaattttccttttcttgattttcttttcccactacaattgactgagtcagactgaacgtgatacttagatacatacatgcaactctcagtactactcctcacctctatataatcttcactctttgctcctccttt

SEQ ID NO: 396 - DNA, 293 bp, Glycine max
  Clone ID: 515O02_region_G2__34598_55
aaagtctggtctgaactgacccatttaattaagaggttaggttcaagcttttttaaaaagcttattaaattaaatagatcagacttaggcttgttaaaaagccttataagtctgataggtcggcctatatatatatatatatatatgtatatgtatatatatatatatatgtatatatatttatattatttgttgataccaatttatacttatattattttttgggtacaattaatttttttttgaaaccagcagactttgattatacattactgctccataacttccattcc

SEQ ID NO: 397 - DNA, 298 bp, Glycine max
  Clone ID: 515O02_region_G2__77680_13
tgacatgaactatctcaaacaatgcaaaaattgtccccttaaaggcaataccccctttcccccccttaaaatttggctttcaaaaagtacttttttcaaaatacattaatttttaacatggctagaaagtatttttgaaatattaaaattttaacacttccagaaaatattttctgaaatgtgttgaaattttttaatctgttttgaaaagtagtttccaaaaaagagatacttgtagaagaagaagaatatatatatatagtattagtaaatctgggaggtgtaaataacagttgtt

SEQ ID NO: 398 - DNA, 298 bp, Glycine max; identical to SEQ ID NO: 397
  Clone ID: 515O02_region_G2__77693_12

SEQ ID NO: 399 - DNA, 300 bp, Glycine max
  Clone ID: 515O02_region_G2__97392_14
tttgatgtagttgatttatgcactcgattgtacaaatataattgtttttaaatattgtgcaaatgggttttggggatttcacttacttaatatgatttagaaacattattattattatttctgtaaaaaaaaagaaatattattattattacaatttcttcatccttcttatatacttttttaaaaacgaaaaaaaaaaatattgagtttcgtttatgattaagaaaaatgtttcataattaaaaattaaaaactagtgtctgcatcatcacattactaaactaggttgcctgatgtcac

SEQ ID NO: 400 - DNA, 300 bp, Glycine max; identical to SEQ ID NO: 399
  Clone ID: 515O02_region_G2__97359_15

SEQ ID NO: 401 - DNA, 25 bp, Glycine max
  Clone ID: 240O17_region_G3__289711_11_Forward_Primer
aaaccttgacgttgttgtctttgtt

SEQ ID NO: 402 - DNA, 25 bp, Glycine max
  Clone ID: 240O17_region_G3__289711_11_Reverse_Primer
ggaatattgtaccaatcacccggta

SEQ ID NO: 403 - DNA, 25 bp, Glycine max
  Clone ID: 240O17_region_G3__236585_14_Forward_Primer
agtccgggagattagttgcagtaaa

SEQ ID NO: 404 - DNA, 25 bp, Glycine max
  Clone ID: 240O17_region_G3__236585_14_Reverse_Primer
tgaagatctgaatctgattgcctga

SEQ ID NO: 405 - DNA, 25 bp, Glycine max
  Clone ID: 240O17_region_G3__168772_13_Forward_Primer
tttgcattgtttcaatttatttcca

SEQ ID NO: 406 - DNA, 26 bp, Glycine max
  Clone ID: 240O17_region_G3__168772_13_Reverse_Primer
aatttcaaccaacagacattgagtga

SEQ ID NO: 407 - DNA, 25 bp, Glycine max
  Clone ID: 240O17_region_G3__332420_21_Forward_Primer
gagaatctgcaactgaaccaaatga

SEQ ID NO: 408 - DNA, 25 bp, Glycine max
  Clone ID: 240O17_region_G3__332420_21_Reverse_Primer
acttaggaatggaacagcagactgg

SEQ ID NO: 409 - DNA, 25 bp, Glycine max
  Clone ID: 240O17_region_G3__228126_18_Forward_Primer
atagctctgttgcaaaggaagatgg

SEQ ID NO: 410 - DNA, 25 bp, Glycine max
  Clone ID: 240O17_region_G3__228126_18_Reverse_Primer
attggcatgcaagatatcaggagaa

SEQ ID NO: 411 - DNA, 25 bp, Glycine max
  Clone ID: 240O17_region_G3__139723_11_Forward_Primer
ttgcattcaaattcatggaactacc

SEQ ID NO: 412 - DNA, 25 bp, Glycine max
  Clone ID: 240O17_region_G3__139723_11_Reverse_Primer
tcaccatgtgtgcatgaaacataac

SEQ ID NO: 413 - DNA, 27 bp, Glycine max
  Clone ID: 240O17_region_G3__280585_14_Forward_Primer
tttacaagtgcatcatttaacttctca

SEQ ID NO: 414 - DNA, 25 bp, Glycine max
  Clone ID: 240O17_region_G3__280585_14_Reverse_Primer
tttggcctcaatttaaagatcctgt

SEQ ID NO: 415 - DNA, 25 bp, Glycine max
  Clone ID: 240O17_region_G3__70509_14_Forward_Primer
cctatgaagaatacacccacgttga

SEQ ID NO: 416 - DNA, 25 bp, Glycine max
  Clone ID: 240O17_region_G3__70509_14_Reverse_Primer
cagcctccatcaggaagatgaatac

SEQ ID NO: 417 - DNA, 25 bp, Glycine max
  Clone ID: 240O17_region_G3__50537_17_Forward_Primer
aaacccaacataattccaacttcaa

SEQ ID NO: 418 - DNA, 25 bp, Glycine max
  Clone ID: 240O17_region_G3__50537_17_Reverse_Primer
agcagagcatcccaaattaatgcta

SEQ ID NO: 419 - DNA, 25 bp, Glycine max
  Clone ID: 240O17_region_G3__231556_17_Forward_Primer
agcccttccacaaactagagcgtat

SEQ ID NO: 420 - DNA, 25 bp, Glycine max
  Clone ID: 240O17_region_G3__231556_17_Reverse_Primer
ttctgccgaaacacttccagtaaat

SEQ ID NO: 421 - DNA, 25 bp, Glycine max
  Clone ID: 240O17_region_G3__117057_11_Forward_Primer
aaagacggaacagcgtcaaataaac

SEQ ID NO: 422 - DNA, 25 bp, Glycine max
  Clone ID: 240O17_region_G3__117057_11_Reverse_Primer
gacggaaacacgctctacaattaca

SEQ ID NO: 423 - DNA, 25 bp, Glycine max
  Clone ID: 240O17_region_G3__23092_13_Forward_Primer
tcaataggtactggcacaagacacc

SEQ ID NO: 424 - DNA, 25 bp, Glycine max
  Clone ID: 240O17_region_G3__23092_13_Reverse_Primer
ttagccctttatgtcctctcattcc

SEQ ID NO: 425 - DNA, 25 bp, Glycine max
  Clone ID: 240O17_region_G3__297741_14_Forward_Primer
tttataaatctgtccagccaccaaa

SEQ ID NO: 426 - DNA, 25 bp, Glycine max
  Clone ID: 240O17_region_G3__297741_14_Reverse_Primer
agaactagattggtatgcccgtgct

SEQ ID NO: 427 - DNA, 25 bp, Glycine max
  Clone ID: 240O17_region_G3__206502_14_Forward_Primer
agaagaagacgacgacatcgaagag

SEQ ID NO: 428 - DNA, 20 bp, Glycine max
  Clone ID: 240O17_region_G3__206502_14_Reverse_Primer
ggacagggtttccagcttcg

SEQ ID NO: 429 - DNA, 25 bp, Glycine max
  Clone ID: 240O17_region_G3__221223_13_Forward_Primer
ccagagtcttgtaagaaagccatca

SEQ ID NO: 430 - DNA, 25 bp, Glycine max
  Clone ID: 240O17_region_G3__221223_13_Reverse_Primer
cagctgacacatgtccattctttct

SEQ ID NO: 431 - DNA, 25 bp, Glycine max
  Clone ID: 240O17_region_G3__169084_14_Forward_Primer
tttgcttgaataaatgtgcacagaa

SEQ ID NO: 432 - DNA, 24 bp, Glycine max
  Clone ID: 240O17_region_G3__169084_14_Reverse_Primer
gcaaaggttgctccttctgaattt

SEQ ID NO: 433 - DNA, 25 bp, Glycine max
  Clone ID: 240O17_region_G3__94891_14_Forward_Primer
catcaacaaatcacacacacacaca

SEQ ID NO: 434 - DNA, 25 bp, Glycine max
  Clone ID: 240O17_region_G3__94891_14_Reverse_Primer
tccaactgaagagaagaaggcattg

SEQ ID NO: 435 - DNA, 25 bp, Glycine max
  Clone ID: 240O17_region_G3__7439_12_Forward_Primer
ggtgctgtagtgcttgaaacagttg

SEQ ID NO: 436 - DNA, 25 bp, Glycine max
  Clone ID: 240O17_region_G3__7439_12_Reverse_Primer
accaatgtaaatgcgaacacagaaa

SEQ ID NO: 437 - DNA, 25 bp, Glycine max
  Clone ID: 240O17_region_G3__281852_61_Forward_Primer
aaccagaggaaacagggagtcattt

SEQ ID NO: 438 - DNA, 25 bp, Glycine max
  Clone ID: 240O17_region_G3__281852_61_Reverse_Primer
cagtctttcattaatcctccgtcgt

SEQ ID NO: 439 - DNA, 25 bp, Glycine max
  Clone ID: 240O17_region_G3__46583_12_Forward_Primer
gtaacaaattctgaaccctgcatgt

SEQ ID NO: 440 - DNA, 25 bp, Glycine max
  Clone ID: 240O17_region_G3__46583_12_Reverse_Primer
tgtgttgcaagttgaagaatggttt

SEQ ID NO: 441 - DNA, 25 bp, Glycine max
  Clone ID: 240O17_region_G3__306835_13_Forward_Primer
agtctcccagatgatcaattctgct

SEQ ID NO: 442 - DNA, 26 bp, Glycine max
  Clone ID: 240O17_region_G3__306835_13_Reverse_Primer
aaatcacatccaagacgtgaaactaa

SEQ ID NO: 443 - DNA, 25 bp, Glycine max
  Clone ID: 240O17_region_G3__85471_12_Forward_Primer
cgtggccacttgatctataagagag

SEQ ID NO: 444 - DNA, 25 bp, Glycine max
  Clone ID: 240O17_region_G3__85471_12_Reverse_Primer
atattagcttctttgctttcccttg

SEQ ID NO: 445 - DNA, 25 bp, Glycine max
  Clone ID: 240O17_region_G3__257208_12_Forward_Primer
ccatgaatgaaactcaccaaactga

SEQ ID NO: 446 - DNA, 25 bp, Glycine max
  Clone ID: 240O17_region_G3__257208_12_Reverse_Primer
aattactatgattctggctggcaca

SEQ ID NO: 447 - DNA, 25 bp, Glycine max
  Clone ID: 240O17_region_G3__150390_17_Forward_Primer
ttacgcactcagatttggatttgat

SEQ ID NO: 448 - DNA, 25 bp, Glycine max
  Clone ID: 240O17_region_G3__150390_17_Reverse_Primer
agggtgtgaagtttaatcaccatga

SEQ ID NO: 449 - DNA, 24 bp, Glycine max
  Clone ID: 240O17_region_G3__34697_75_Forward_Primer
gcatgctcttaggtgattgcagag

SEQ ID NO: 450 - DNA, 25 bp, Glycine max
  Clone ID: 240O17_region_G3__34697_75_Reverse_Primer
ttcatgaaggcagttgaatgtatcc

SEQ ID NO: 451 - DNA, 25 bp, Glycine max
  Clone ID: 240O17_region_G3__150374_13_Forward_Primer
ttacgcactcagatttggatttgat

SEQ ID NO: 452 - DNA, 25 bp, Glycine max
  Clone ID: 240O17_region_G3__150374_13_Reverse_Primer
agggtgtgaagtttaatcaccatga

SEQ ID NO: 453 - DNA, 25 bp, Glycine max
  Clone ID: 240O17_region_G3__40513_22_Forward_Primer
attctgaaattggtggaaggttctg

SEQ ID NO: 454 - DNA, 25 bp, Glycine max
  Clone ID: 240O17_region_G3__40513_22_Reverse_Primer
caaataaatgtgaagccacacctga

SEQ ID NO: 455 - DNA, 25 bp, Glycine max
  Clone ID: 240O17_region_G3__268602_14_Forward_Primer
aacacgtctcatctcaagaagctca

SEQ ID NO: 456 - DNA, 25 bp, Glycine max
  Clone ID: 240O17_region_G3__268602_14_Reverse_Primer
taacttcgaccaaataggcctagca

SEQ ID NO: 457 - DNA, 25 bp, Glycine max
  Clone ID: 240O17_region_G3__25357_13_Forward_Primer
acttctcccacactttccctttctc

SEQ ID NO: 458 - DNA, 21 bp, Glycine max
  Clone ID: 240O17_region_G3__25357_13_Reverse_Primer
agcggaatctcctctggcttc

SEQ ID NO: 459 - DNA, 24 bp, Glycine max
  Clone ID: 240O17_region_G3__137548_13_Forward_Primer
gtatgaaccctaaagctggcttcg

SEQ ID NO: 460 - DNA, 25 bp, Glycine max
  Clone ID: 240O17_region_G3__137548_13_Reverse_Primer
gcacagatttgttaagaggaatgct

SEQ ID NO: 461 - DNA, 24 bp, Glycine max
  Clone ID: 240O17_region_G3__139131_13_Forward_Primer
gtatgaaccctaaagctggcttcg

SEQ ID NO: 462 - DNA, 25 bp, Glycine max
  Clone ID: 240O17_region_G3__139131_13_Reverse_Primer
gcacagatttgttaagaggaatgct

SEQ ID NO: 463 - DNA, 25 bp, Glycine max
  Clone ID: 240O17_region_G3__203855_12_Forward_Primer
ttgttgtcaagagaagggaagctct

SEQ ID NO: 464 - DNA, 25 bp, Glycine max
  Clone ID: 240O17_region_G3__203855_12_Reverse_Primer
tcatgtgctcacatctgtgttgttt

SEQ ID NO: 465 - DNA, 26 bp, Glycine max
  Clone ID: 240O17_region_G3__199049_15_Forward_Primer
ggcaaatcacatgtacataagggaga

SEQ ID NO: 466 - DNA, 25 bp, Glycine max
  Clone ID: 240O17_region_G3__199049_15_Reverse_Primer
tcaccaaataaactcactgagcaaa

SEQ ID NO: 467 - DNA, 22 bp, Glycine max
  Clone ID: 240O17_region_G3__320907_12_Forward_Primer
gattcgccggaaattctctcct

SEQ ID NO: 468 - DNA, 24 bp, Glycine max
  Clone ID: 240O17_region_G3__320907_12_Reverse_Primer
ctccgatattaagctcgccatcct

SEQ ID NO: 469 - DNA, 25 bp, Glycine max
  Clone ID: 240O17_region_G3__16407_17_Forward_Primer
cacactctcacagcaacttctcgat

SEQ ID NO: 470 - DNA, 25 bp, Glycine max
  Clone ID: 240O17_region_G3__16407_17_Reverse_Primer
atatcactgatccacgtgggatttc

SEQ ID NO: 471 - DNA, 25 bp, Glycine max
  Clone ID: 240O17_region_G3__206516_17_Forward_Primer
cagaagacgaagacgaagaagagga

SEQ ID NO: 472 - DNA, 20 bp, Glycine max
  Clone ID: 240O17_region_G3__206516_17_Reverse_Primer
actcggattgggaccagctc

SEQ ID NO: 473 - DNA, 25 bp, Glycine max
  Clone ID: 240O17_region_G3__264495_13_Forward_Primer
agtggcataaagcaagaagttcacc

SEQ ID NO: 474 - DNA, 25 bp, Glycine max
  Clone ID: 240O17_region_G3__264495_13_Reverse_Primer
gagattcaagggaatgcatactgaa

SEQ ID NO: 475 - DNA, 25 bp, Glycine max
  Clone ID: 240O17_region_G3__156785_13_Forward_Primer
atctagtgcctccacgcatctctac

SEQ ID NO: 476 - DNA, 25 bp, Glycine max
  Clone ID: 240O17_region_G3__156785_13_Reverse_Primer
gttggcgttgaagagagagaaagag

SEQ ID NO: 477 - DNA, 25 bp, Glycine max
  Clone ID: 240O17_region_G3__187129_12_Forward_Primer
tgattgggaaggaaagcttcattag

SEQ ID NO: 478 - DNA, 25 bp, Glycine max
  Clone ID: 240O17_region_G3__187129_12_Reverse_Primer
atttatcttgcaccatgaccaaacc

SEQ ID NO: 479 - DNA, 26 bp, Glycine max
  Clone ID: 240O17_region_G3__214106_13_Forward_Primer
ccatcttcttctcaatcctcatgttg

SEQ ID NO: 480 - DNA, 25 bp, Glycine max
  Clone ID: 240O17_region_G3__214106_13_Reverse_Primer
gtttaaagtagagcacgcggagagc

SEQ ID NO: 481 - DNA, 25 bp, Glycine max
  Clone ID: 240O17_region_G3__149013_12_Forward_Primer
aagctcaacgtggatgtttgttaga

SEQ ID NO: 482 - DNA, 27 bp, Glycine max
  Clone ID: 240O17_region_G3__149013_12_Reverse_Primer
gcacactagacatttatttcgctttga

SEQ ID NO: 483 - DNA, 25 bp, Glycine max
  Clone ID: 240O17_region_G3__326352_16_Forward_Primer
gttgttaccttgtgtgttcgctttg

SEQ ID NO: 484 - DNA, 25 bp, Glycine max
  Clone ID: 240O17_region_G3__326352_16_Reverse_Primer
agggttgtggaagcaagttcatatc

SEQ ID NO: 485 - DNA, 25 bp, Glycine max
  Clone ID: 240O17_region_G3__278962_12_Forward_Primer
tcgaatctatcgcggaatactcaat

SEQ ID NO: 486 - DNA, 25 bp, Glycine max
  Clone ID: 240O17_region_G3__278962_12_Reverse_Primer
tttccttagctcaatttgcaactcc

SEQ ID NO: 487 - DNA, 25 bp, Glycine max
  Clone ID: 240O17_region_G3__256930_13_Forward_Primer
tgtgacctatctttcctccgttctc

SEQ ID NO: 488 - DNA, 25 bp, Glycine max
  Clone ID: 240O17_region_G3__256930_13_Reverse_Primer
tcccaagtctgataaggtaaaccaa

SEQ ID NO: 489 - DNA, 25 bp, Glycine max
  Clone ID: 240O17_region_G3__29646_14_Forward_Primer
acgcaactcagatgcattaacacaa

SEQ ID NO: 490 - DNA, 26 bp, Glycine max
  Clone ID: 240O17_region_G3__29646_14_Reverse_Primer
tgaataatgatcatcgtccactgata

SEQ ID NO: 491 - DNA, 25 bp, Glycine max
  Clone ID: 240O17_region_G3__29618_13_Forward_Primer
acgcaactcagatgcattaacacaa

SEQ ID NO: 492 - DNA, 26 bp, Glycine max
  Clone ID: 240O17_region_G3__29618_13_Reverse_Primer
tgaataatgatcatcgtccactgata

SEQ ID NO: 493 - DNA, 25 bp, Glycine max
  Clone ID: 240O17_region_G3__108561_14_Forward_Primer
aatgttgcttgccttcacagctaag

SEQ ID NO: 494 - DNA, 25 bp, Glycine max
  Clone ID: 240O17_region_G3__108561_14_Reverse_Primer
tccaaacccttattcataacccaga

SEQ ID NO: 495 - DNA, 26 bp, Glycine max
  Clone ID: 240O17_region_G3__143975_14_Forward_Primer
cggtagctatagcgtattgcaacaaa

SEQ ID NO: 496 - DNA, 25 bp, Glycine max
  Clone ID: 240O17_region_G3__143975_14_Reverse_Primer
cccatcgtcagtagtatcacattca

SEQ ID NO: 497 - DNA, 25 bp, Glycine max
  Clone ID: 240O17_region_G3__108431_20_Forward_Primer
ccgaatgacagagaggaagaagaaa

SEQ ID NO: 498 - DNA, 24 bp, Glycine max
  Clone ID: 240O17_region_G3__108431_20_Reverse_Primer
atttcaacttcccacaccactgac

SEQ ID NO: 499 - DNA, 25 bp, Glycine max
  Clone ID: 240O17_region_G3__281764_11_Forward_Primer
ttcctggtgagtaacaagtgtaggg

SEQ ID NO: 500 - DNA, 25 bp, Glycine max
  Clone ID: 240O17_region_G3__281764_11_Reverse_Primer
tctggttcatgctctattcaaacga

SEQ ID NO: 501 - DNA, 25 bp, Glycine max
  Clone ID: 240O17_region_G3__130058_15_Forward_Primer
agtctcgctcctatttcgagtcctt

SEQ ID NO: 502 - DNA, 25 bp, Glycine max
  Clone ID: 240O17_region_G3__130058_15_Reverse_Primer
gtgccaccttgaatccacttatcat

SEQ ID NO: 503 - DNA, 25 bp, Glycine max
  Clone ID: 240O17_region_G3__310590_52_Forward_Primer
ttccctaataatggtggaagcagtt

SEQ ID NO: 504 - DNA, 25 bp, Glycine max
  Clone ID: 240O17_region_G3__310590_52_Reverse_Primer
acccaaacccaatatggtgttctac

SEQ ID NO: 505 - DNA, 25 bp, Glycine max
  Clone ID: 240O17_region_G3__313405_14_Forward_Primer
cggatgttaaatgattggttcgttt

SEQ ID NO: 506 - DNA, 25 bp, Glycine max
  Clone ID: 240O17_region_G3__313405_14_Reverse_Primer
aattatgttggactggttctggaaa

SEQ ID NO: 507 - DNA, 27 bp, Glycine max
  Clone ID: 240O17_region_G3__302190_13_Forward_Primer
ttaacccactaccaaatatactccaaa

SEQ ID NO: 508 - DNA, 25 bp, Glycine max
  Clone ID: 240O17_region_G3__302190_13_Reverse_Primer
caagttcggttaggatgaacacgat

SEQ ID NO: 509 - DNA, 24 bp, Glycine max
  Clone ID: 240O17_region_G3__225343_17_Forward_Primer
cccgcaatttgttatagtgggaaa

SEQ ID NO: 510 - DNA, 25 bp, Glycine max
  Clone ID: 240O17_region_G3__225343_17_Reverse_Primer
agtaaatgtcacttcaaacgcatgg

SEQ ID NO: 511 - DNA, 25 bp, Glycine max
  Clone ID: 240O17_region_G3__208823_14_Forward_Primer
tactttccaaattgatgcagaccag

SEQ ID NO: 512 - DNA, 25 bp, Glycine max
  Clone ID: 240O17_region_G3__208823_14_Reverse_Primer
tgtcccaaatagggagttacaagga

SEQ ID NO: 513 - DNA, 25 bp, Glycine max
  Clone ID: 240O17_region_G3__74285_11_Forward_Primer
tgatgacaatgatgacgatttgtga

SEQ ID NO: 514 - DNA, 25 bp, Glycine max
  Clone ID: 240O17_region_G3__74285_11_Reverse_Primer
aattcatctgcaacgtcctggtaag

SEQ ID NO: 515 - DNA, 25 bp, Glycine max
  Clone ID: 240O17_region_G3__109052_16_Forward_Primer
cacatttgatgattgattccagttt

SEQ ID NO: 516 - DNA, 25 bp, Glycine max
  Clone ID: 240O17_region_G3__109052_16_Reverse_Primer
ccataatgtcagtgctttctggcta

SEQ ID NO: 517 - DNA, 25 bp, Glycine max
  Clone ID: 240O17_region_G3__6395_12_Forward_Primer
tactactgaaccgtggtgcctgata

SEQ ID NO: 518 - DNA, 25 bp, Glycine max
  Clone ID: 240O17_region_G3__6395_12_Reverse_Primer
gccatacaaatgcattgtggttaat

SEQ ID NO: 519 - DNA, 26 bp, Glycine max
  Clone ID: 240O17_region_G3__244905_16_Forward_Primer
tgaaatccaagtgaaagattgttaaa

SEQ ID NO: 520 - DNA, 25 bp, Glycine max
  Clone ID: 240O17_region_G3__244905_16_Reverse_Primer
tatgcgtattacctccaacgtccat

SEQ ID NO: 521 - DNA, 26 bp, Glycine max
  Clone ID: 240O17_region_G3__244956_13_Forward_Primer
tgaaatccaagtgaaagattgttaaa

SEQ ID NO: 522 - DNA, 25 bp, Glycine max
  Clone ID: 240O17_region_G3__244956_13_Reverse_Primer
tatgcgtattacctccaacgtccat

SEQ ID NO: 523 - DNA, 25 bp, Glycine max
  Clone ID: 240O17_region_G3__117220_13_Forward_Primer
aagagaattggcaaagtgcagtagc

SEQ ID NO: 524 - DNA, 25 bp, Glycine max
  Clone ID: 240O17_region_G3__117220_13_Reverse_Primer
ctcccatcttcttcactctcagcat

SEQ ID NO: 525 - DNA, 25 bp, Glycine max
  Clone ID: 240O17_region_G3__134707_14_Forward_Primer
tgtacatcaaactggcaaggaagag

SEQ ID NO: 526 - DNA, 25 bp, Glycine max
  Clone ID: 240O17_region_G3__134707_14_Reverse_Primer
gagattgcacagaagggaaattgtt

SEQ ID NO: 527 - DNA, 24 bp, Glycine max
  Clone ID: 240O17_region_G3__35078_13_Forward_Primer
agcaagatcagaagtcgcaaacac

SEQ ID NO: 528 - DNA, 25 bp, Glycine max
  Clone ID: 240O17_region_G3__35078_13_Reverse_Primer
ctcccattcttccatttccatttct

SEQ ID NO: 529 - DNA, 25 bp, Glycine max
  Clone ID: 240O17_region_G3__210506_16_Forward_Primer
ttgatattgttgcaaatcacctgaa

SEQ ID NO: 530 - DNA, 25 bp, Glycine max
  Clone ID: 240O17_region_G3__210506_16_Reverse_Primer
gaggtcaagtaagtgccacatcaga

SEQ ID NO: 531 - DNA, 25 bp, Glycine max
  Clone ID: 240O17_region_G3__116961_26_Forward_Primer
atccgggaaatgattctaaacatga

SEQ ID NO: 532 - DNA, 25 bp, Glycine max
  Clone ID: 240O17_region_G3__116961_26_Reverse_Primer
gtttatttgacgctgttccgtcttt

SEQ ID NO: 533 - DNA, 25 bp, Glycine max
  Clone ID: 240O17_region_G3__51073_13_Forward_Primer
caaattgccacatttctcatgtcag

SEQ ID NO: 534 - DNA, 25 bp, Glycine max
  Clone ID: 240O17_region_G3__51073_13_Reverse_Primer
gtgtgtagaggctaaggcttgagga

SEQ ID NO: 535 - DNA, 25 bp, Glycine max
  Clone ID: 240O17_region_G3__55291_15_Forward_Primer
ccctagggacaacagggtacctaat

SEQ ID NO: 536 - DNA, 25 bp, Glycine max
  Clone ID: 240O17_region_G3__55291_15_Reverse_Primer
atggtcctgactcgtgtaaccaaat

SEQ ID NO: 537 - DNA, 25 bp, Glycine max
  Clone ID: 240O17_region_G3__229651_18_Forward_Primer
acaatcaaggaatctaagccacaca

SEQ ID NO: 538 - DNA, 25 bp, Glycine max
  Clone ID: 240O17_region_G3__229651_18_Reverse_Primer
ctgttcttgcagtaatgttggcact

SEQ ID NO: 539 - DNA, 24 bp, Glycine max
  Clone ID: 240O17_region_G3__303308_19_Forward_Primer
caactcctctttcaattcgcacac

SEQ ID NO: 540 - DNA, 26 bp, Glycine max
  Clone ID: 240O17_region_G3__303308_19_Reverse_Primer
tgtggaatttgttgtgtctaagggta

SEQ ID NO: 541 - DNA, 25 bp, Glycine max
  Clone ID: 240O17_region_G3__168373_20_Forward_Primer
gaacaggctatcatggctgaagaag

SEQ ID NO: 542 - DNA, 25 bp, Glycine max
  Clone ID: 240O17_region_G3__168373_20_Reverse_Primer
atcagatgatgctgaatgcttgtgt

SEQ ID NO: 543 - DNA, 25 bp, Glycine max
  Clone ID: 240O17_region_G3__253333_17_Forward_Primer
gtcatcacccatataaacttgtcca

SEQ ID NO: 544 - DNA, 25 bp, Glycine max
  Clone ID: 240O17_region_G3__253333_17_Reverse_Primer
aagattcgcttccatcaacatcaat

SEQ ID NO: 545 - DNA, 25 bp, Glycine max
  Clone ID: 240O17_region_G3__5791_13_Forward_Primer
aaagagagattagggaaccattgga

SEQ ID NO: 546 - DNA, 26 bp, Glycine max
  Clone ID: 240O17_region_G3__5791_13_Reverse_Primer
aatccaaatagaaatttcgtgtcagt

SEQ ID NO: 547 - DNA, 20 bp, Glycine max
  Clone ID: 240O17_region_G3__206841_19_Forward_Primer
agctgcctcacaccgccaat

SEQ ID NO: 548 - DNA, 25 bp, Glycine max
  Clone ID: 240O17_region_G3__206841_19_Reverse_Primer
actagcatctctcggtccctcactt

SEQ ID NO: 549 - DNA, 25 bp, Glycine max
  Clone ID: 240O17_region_G3__202827_12_Forward_Primer
agttggctcaaacaaatcagattcc

SEQ ID NO: 550 - DNA, 25 bp, Glycine max
  Clone ID: 240O17_region_G3__202827_12_Reverse_Primer
tgttaggagaagaaccaccaccaag

SEQ ID NO: 551 - DNA, 27 bp, Glycine max
  Clone ID: 240O17_region_G3__322656_13_Forward_Primer
tgtcccaatatcctaggtagagccata

SEQ ID NO: 552 - DNA, 25 bp, Glycine max
  Clone ID: 240O17_region_G3__322656_13_Reverse_Primer
cggtttgatcacattcacttgtcat

SEQ ID NO: 553 - DNA, 25 bp, Glycine max
  Clone ID: 240O17_region_G3__111841_14_Forward_Primer
tgctttagctcagtaacctgcttga

SEQ ID NO: 554 - DNA, 26 bp, Glycine max
  Clone ID: 240O17_region_G3__111841_14_Reverse_Primer
catgttagtttatcttgctggcatcc

SEQ ID NO: 555 - DNA, 25 bp, Glycine max
  Clone ID: 240O17_region_G3__192719_13_Forward_Primer
gctacttcttggcaagctctattcg

SEQ ID NO: 556 - DNA, 25 bp, Glycine max
  Clone ID: 240O17_region_G3__192719_13_Reverse_Primer
gttgttgtgcctttagggtcaatgt

SEQ ID NO: 557 - DNA, 25 bp, Glycine max
  Clone ID: 240O17_region_G3__195630_17_Forward_Primer
ttggagttgagtgttctgatggaag

SEQ ID NO: 558 - DNA, 25 bp, Glycine max
  Clone ID: 240O17_region_G3__195630_17_Reverse_Primer
tctctcgtacgatgaccctaatgaa

SEQ ID NO: 559 - DNA, 24 bp, Glycine max
  Clone ID: 240O17_region_G3__69999_13_Forward_Primer
tttccacaaagactcctgcccttt

SEQ ID NO: 560 - DNA, 25 bp, Glycine max
  Clone ID: 240O17_region_G3__69999_13_Reverse_Primer
tagtgacacagtgtggtggagtgaa

SEQ ID NO: 561 - DNA, 25 bp, Glycine max
  Clone ID: 240O17_region_G3__11176_13_Forward_Primer
cgttctcgtcgaataataccgattc

SEQ ID NO: 562 - DNA, 25 bp, Glycine max
  Clone ID: 240O17_region_G3__11176_13_Reverse_Primer
accaataagattgccttacgaattt

SEQ ID NO: 563 - DNA, 25 bp, Glycine max
  Clone ID: 240O17_region_G3__228643_13_Forward_Primer
gctatagcagctaggaactggtgga

SEQ ID NO: 564 - DNA, 25 bp, Glycine max
  Clone ID: 240O17_region_G3__228643_13_Reverse_Primer
attgatcatcagagcatgaacttcg

SEQ ID NO: 565 - DNA, 25 bp, Glycine max
  Clone ID: 240O17_region_G3__88478_19_Forward_Primer
aagataagatgaggtgctcgtcaaa

SEQ ID NO: 566 - DNA, 25 bp, Glycine max
  Clone ID: 240O17_region_G3__88478_19_Reverse_Primer
ttatactcattcaatgcacgattgg

SEQ ID NO: 567 - DNA, 21 bp, Glycine max
  Clone ID: 240O17_region_G3__108950_13_Forward_Primer
agtgctagctggacgcacaaa

SEQ ID NO: 568 - DNA, 26 bp, Glycine max
  Clone ID: 240O17_region_G3__108950_13_Reverse_Primer
aaactggaatcaatcatcaaatgtgt

SEQ ID NO: 569 - DNA, 25 bp, Glycine max
  Clone ID: 240O17_region_G3__121054_14_Forward_Primer
ctgcatggaaagatgaagcaggtat

SEQ ID NO: 570 - DNA, 25 bp, Glycine max
  Clone ID: 240O17_region_G3__121054_14_Reverse_Primer
gtgctttctccctggcagactataa

SEQ ID NO: 571 - DNA, 25 bp, Glycine max
  Clone ID: 240O17_region_G3__188337_14_Forward_Primer
cacgtaagaccaagacctaacagga

SEQ ID NO: 572 - DNA, 25 bp, Glycine max
  Clone ID: 240O17_region_G3__188337_14_Reverse_Primer
attcaagactgtgcatcttcttcgt

SEQ ID NO: 573 - DNA, 25 bp, Glycine max
  Clone ID: 240O17_region_G3__255944_21_Forward_Primer
taactttgccttaattggttgcaca

SEQ ID NO: 574 - DNA, 25 bp, Glycine max
  Clone ID: 240O17_region_G3__255944_21_Reverse_Primer
attcttcttgccttctcactgccta

SEQ ID NO: 575 - DNA, 25 bp, Glycine max
  Clone ID: 240O17_region_G3__219518_14_Forward_Primer
acgaaatgctcatgatcttctttca

SEQ ID NO: 576 - DNA, 25 bp, Glycine max
  Clone ID: 240O17_region_G3__219518_14_Reverse_Primer
aatctgcaggagagagaaagcgtaa

SEQ ID NO: 577 - DNA, 25 bp, Glycine max
  Clone ID: 240O17_region_G3__235601_15_Forward_Primer
acactcagtcatagccaagcctacc

SEQ ID NO: 578 - DNA, 25 bp, Glycine max
  Clone ID: 240O17_region_G3__235601_15_Reverse_Primer
tgagttggacgaggacaaggtaagt

SEQ ID NO: 579 - DNA, 25 bp, Glycine max
  Clone ID: 240O17_region_G3__301529_13_Forward_Primer
ttagtttacactgccggatcacgtt

SEQ ID NO: 580 - DNA, 25 bp, Glycine max
  Clone ID: 240O17_region_G3__301529_13_Reverse_Primer
gagcagtctaatccattggaaatca

SEQ ID NO: 581 - DNA, 22 bp, Glycine max
  Clone ID: 240O17_region_G3__94795_14_Forward_Primer
ccgtctccaacaccctctcata

SEQ ID NO: 582 - DNA, 25 bp, Glycine max
  Clone ID: 240O17_region_G3__94795_14_Reverse_Primer
tccaactgaagagaagaaggcattg

SEQ ID NO: 583 - DNA, 25 bp, Glycine max
  Clone ID: 240O17_region_G3__46703_23_Forward_Primer
aaaccattcttcaacttgcaacaca

SEQ ID NO: 584 - DNA, 25 bp, Glycine max
  Clone ID: 240O17_region_G3__46703_23_Reverse_Primer
tcttcttgtcagaaacacggttgaa

SEQ ID NO: 585 - DNA, 25 bp, Glycine max
  Clone ID: 240O17_region_G3__59616_14_Forward_Primer
tcatggtaacatggaggcaactatc

SEQ ID NO: 586 - DNA, 25 bp, Glycine max
  Clone ID: 240O17_region_G3__59616_14_Reverse_Primer
ccctaaatcatcaccatcatcactt

SEQ ID NO: 587 - DNA, 25 bp, Glycine max
  Clone ID: 240O17_region_G3__296933_15_Forward_Primer
ttagtggaaacaagcactctctcct

SEQ ID NO: 588 - DNA, 25 bp, Glycine max
  Clone ID: 240O17_region_G3__296933_15_Reverse_Primer
ttctatgctcttgccaccaaatgta

SEQ ID NO: 589 - DNA, 25 bp, Glycine max
  Clone ID: 240O17_region_G3__192428_17_Forward_Primer
ataacagcgaagcaatccattaacc

SEQ ID NO: 590 - DNA, 25 bp, Glycine max
  Clone ID: 240O17_region_G3__192428_17_Reverse_Primer
cgaatagagcttgccaagaagtagc

SEQ ID NO: 591 - DNA, 25 bp, Glycine max
  Clone ID: 240O17_region_G3__191490_14_Forward_Primer
gcataatacattgtgtcttcatcca

SEQ ID NO: 592 - DNA, 25 bp, Glycine max
  Clone ID: 240O17_region_G3__191490_14_Reverse_Primer
attcaagactgtgcatcttcttcgt

SEQ ID NO: 593 - DNA, 25 bp, Glycine max
  Clone ID: 240O17_region_G3__201115_11_Forward_Primer
tctcattgatccttgtccatccata

SEQ ID NO: 594 - DNA, 26 bp, Glycine max
  Clone ID: 240O17_region_G3__201115_11_Reverse_Primer
tgcacaactactaataccatcgtcca

SEQ ID NO: 595 - DNA, 27 bp, Glycine max
  Clone ID: 240O17_region_G3__72882_15_Forward_Primer
tgatcaccacagtaatatcaatcacaa

SEQ ID NO: 596 - DNA, 27 bp, Glycine max
  Clone ID: 240O17_region_G3__72882_15_Reverse_Primer
ggtaatttaatgttcacacatgaccac

SEQ ID NO: 597 - DNA, 27 bp, Glycine max
  Clone ID: 240O17_region_G3__69514_13_Forward_Primer
aaactttgcatcacattgttaatcttt

SEQ ID NO: 598 - DNA, 25 bp, Glycine max
  Clone ID: 240O17_region_G3__69514_13_Reverse_Primer
aatccacctacacgaatttgctcat

SEQ ID NO: 599 - DNA, 25 bp, Glycine max
  Clone ID: 240O17_region_G3__37699_47_Forward_Primer
gtggaatcaagtgagggagaaactc

SEQ ID NO: 600 - DNA, 26 bp, Glycine max
  Clone ID: 240O17_region_G3__37699_47_Reverse_Primer
tctcttctttcttaatcgcctaatca

SEQ ID NO: 601 - DNA, 27 bp, Glycine max
  Clone ID: 240O17_region_G3__11301_29_Forward_Primer
ccatttatacacacacacacacacaca

SEQ ID NO: 602 - DNA, 25 bp, Glycine max
  Clone ID: 240O17_region_G3__11301_29_Reverse_Primer
tcacgtagatttcacacttcctcaa

SEQ ID NO: 603 - DNA, 22 bp, Glycine max
  Clone ID: 240O17_region_G3__141875_12_Forward_Primer
gctcatgattcgggccatattt

SEQ ID NO: 604 - DNA, 26 bp, Glycine max
  Clone ID: 240O17_region_G3__141875_12_Reverse_Primer
tgagcaaattgttgtgttgagtagtg

SEQ ID NO: 605 - DNA, 26 bp, Glycine max
  Clone ID: 240O17_region_G3__98090_18_Forward_Primer
aaacacacactgaacttgttcctaaa

SEQ ID NO: 606 - DNA, 25 bp, Glycine max
  Clone ID: 240O17_region_G3__98090_18_Reverse_Primer
acatatgcagtacaatccgcagaag

SEQ ID NO: 607 - DNA, 25 bp, Glycine max
  Clone ID: 240O17_region_G3__43298_35_Forward_Primer
tggttccataagactctcgaacaaa

SEQ ID NO: 608 - DNA, 25 bp, Glycine max
  Clone ID: 240O17_region_G3__43298_35_Reverse_Primer
acatgtatcacgggtgaacaacatt

SEQ ID NO: 609 - DNA, 26 bp, Glycine max
  Clone ID: 240O17_region_G3__262094_11_Forward_Primer
ggatccaaccgactagatcagtctaa

SEQ ID NO: 610 - DNA, 26 bp, Glycine max
  Clone ID: 240O17_region_G3__262094_11_Reverse_Primer
ttctaatgacactttgtgaatgaagg

SEQ ID NO: 611 - DNA, 26 bp, Glycine max
  Clone ID: 240O17_region_G3__262079_15_Forward_Primer
ggatccaaccgactagatcagtctaa

SEQ ID NO: 612 - DNA, 26 bp, Glycine max
  Clone ID: 240O17_region_G3__262079_15_Reverse_Primer
ttctaatgacactttgtgaatgaagg

SEQ ID NO: 613 - DNA, 27 bp, Glycine max
  Clone ID: 240O17_region_G3__59090_12_Forward_Primer
tctcatttatctatctcccaaggtgtg

SEQ ID NO: 614 - DNA, 25 bp, Glycine max
  Clone ID: 240O17_region_G3__59090_12_Reverse_Primer
cctaacaccgtgcctaaggacataa

SEQ ID NO: 615 - DNA, 25 bp, Glycine max
  Clone ID: 240O17_region_G3__245723_13_Forward_Primer
aacgttgatgtctactgctcccaat

SEQ ID NO: 616 - DNA, 25 bp, Glycine max
  Clone ID: 240O17_region_G3__245723_13_Reverse_Primer
gcgcgtggataataattgtttgttt

SEQ ID NO: 617 - DNA, 27 bp, Glycine max
  Clone ID: 240O17_region_G3__194628_54_Forward_Primer
gattaggcacccataatataaatcctt

SEQ ID NO: 618 - DNA, 25 bp, Glycine max
  Clone ID: 240O17_region_G3__194628_54_Reverse_Primer
atgttaccaactccgacacgtcagt

SEQ ID NO: 619 - DNA, 25 bp, Glycine max
  Clone ID: 240O17_region_G3__4566_16_Forward_Primer
ccaaacacctcctcaattgtagacc

SEQ ID NO: 620 - DNA, 27 bp, Glycine max
  Clone ID: 240O17_region_G3__4566_16_Reverse_Primer
tttcttgaagtttgcctgtgtactatc

SEQ ID NO: 621 - DNA, 25 bp, Glycine max
  Clone ID: 240O17_region_G3__96209_14_Forward_Primer
ttgatgagctggctggttagttaaa

SEQ ID NO: 622 - DNA, 25 bp, Glycine max
  Clone ID: 240O17_region_G3__96209_14_Reverse_Primer
gtaatgtaggctttcgctccctctt

SEQ ID NO: 623 - DNA, 25 bp, Glycine max
  Clone ID: 240O17_region_G3__248715_17_Forward_Primer
agcaaatgctttaattacgctgaaa

SEQ ID NO: 624 - DNA, 25 bp, Glycine max
  Clone ID: 240O17_region_G3__248715_17_Reverse_Primer
ttcttgtggtattgcttgctactcg

SEQ ID NO: 625 - DNA, 23 bp, Glycine max
  Clone ID: 240O17_region_G3__71410_40_Forward_Primer
gagtccttcaaattggcgtcttt

SEQ ID NO: 626 - DNA, 26 bp, Glycine max
  Clone ID: 240O17_region_G3__71410_40_Reverse_Primer
aagtttggctagattcaagaaacaaa

SEQ ID NO: 627 - DNA, 25 bp, Glycine max
  Clone ID: 240O17_region_G3__226519_13_Forward_Primer
ataatgcccacgatccaagtgtatt

SEQ ID NO: 628 - DNA, 25 bp, Glycine max
  Clone ID: 240O17_region_G3__226519_13_Reverse_Primer
tccatttccgtactccaactttcat

SEQ ID NO: 629 - DNA, 26 bp, Glycine max
  Clone ID: 240O17_region_G3__11282_19_Forward_Primer
cgaaattcgtaaggcaatcttattgg

SEQ ID NO: 630 - DNA, 25 bp, Glycine max
  Clone ID: 240O17_region_G3__11282_19_Reverse_Primer
tcacgtagatttcacacttcctcaa

SEQ ID NO: 631 - DNA, 25 bp, Glycine max
  Clone ID: 240O17_region_G3__170504_12_Forward_Primer
aaccaaacctgggttgaacttgttt

SEQ ID NO: 632 - DNA, 24 bp, Glycine max
  Clone ID: 240O17_region_G3__170504_12_Reverse_Primer
aaatgaaatccaaatcgggccagt

SEQ ID NO: 633 - DNA, 27 bp, Glycine max
  Clone ID: 240O17_region_G3__40864_14_Forward_Primer
ggactgattggtacgaccattagttta

SEQ ID NO: 634 - DNA, 27 bp, Glycine max
  Clone ID: 240O17_region_G3__40864_14_Reverse_Primer
gcacatgacaaatcacattactctcaa

SEQ ID NO: 635 - DNA, 25 bp, Glycine max
  Clone ID: 240O17_region_G3__13529_14_Forward_Primer
cgtgccaatcatcgatacagtacaa

SEQ ID NO: 636 - DNA, 25 bp, Glycine max
  Clone ID: 240O17_region_G3__13529_14_Reverse_Primer
cacaccaccagagtgtaagctgttt

SEQ ID NO: 637 - DNA, 25 bp, Glycine max
  Clone ID: 240O17_region_G3__22858_14_Forward_Primer
tcaattaaagggataaggacccatt

SEQ ID NO: 638 - DNA, 25 bp, Glycine max
  Clone ID: 240O17_region_G3__22858_14_Reverse_Primer
tttagagcccatttgtttcaacttt

SEQ ID NO: 639 - DNA, 27 bp, Glycine max
  Clone ID: 240O17_region_G3__309211_13_Forward_Primer
aaagttgaatggtttgacagagataaa

SEQ ID NO: 640 - DNA, 26 bp, Glycine max
  Clone ID: 240O17_region_G3__309211_13_Reverse_Primer
aaacactactgctgattatcccaaga

SEQ ID NO: 641 - DNA, 25 bp, Glycine max
  Clone ID: 240O17_region_G3__55568_26_Forward_Primer
aggcatagaagcactaatggtgaca

SEQ ID NO: 642 - DNA, 26 bp, Glycine max
  Clone ID: 240O17_region_G3__55568_26_Reverse_Primer
cctcctctcttgtaataggtcgatga

SEQ ID NO: 643 - DNA, 27 bp, Glycine max
  Clone ID: 240O17_region_G3__73238_16_Forward_Primer
tggtcatgtgtgaacattaaattacct

SEQ ID NO: 644 - DNA, 25 bp, Glycine max
  Clone ID: 240O17_region_G3__73238_16_Reverse_Primer
tcactccgtctgtcccttattacaa

SEQ ID NO: 645 - DNA, 25 bp, Glycine max
  Clone ID: 240O17_region_G3__52488_19_Forward_Primer
atgtgcattggatgttctaccatag

SEQ ID NO: 646 - DNA, 25 bp, Glycine max
  Clone ID: 240O17_region_G3__52488_19_Reverse_Primer
accaacaatacacaccgtacgtcat

SEQ ID NO: 647 - DNA, 25 bp, Glycine max
  Clone ID: 318O13_region_A3__471518_14_Forward_Primer_Seq
ttgcaactacctgcaacgaggatac

SEQ ID NO: 648 - DNA, 27 bp, Glycine max
  Clone ID: 318O13_region_A3__471518_14_Reverse_Primer_Seq
aattatgtaattacgcgagattctcct

SEQ ID NO: 649 - DNA, 25 bp, Glycine max
  Clone ID: 318O13_region_A3__231599_23_Forward_Primer_Seq
cttcaaggctttggagaacaaacat

SEQ ID NO: 650 - DNA, 22 bp, Glycine max
  Clone ID: 318O13_region_A3__231599_23_Reverse_Primer_Seq
aggtcctcgtactcctcctcct

SEQ ID NO: 651 - DNA, 21 bp, Glycine max
  Clone ID: 318O13_region_A3__375912_13_Forward_Primer_Seq
gacgcatctgtcacgaacgac

SEQ ID NO: 652 - DNA, 23 bp, Glycine max
  Clone ID: 318O13_region_A3__375912_13_Reverse_Primer_Seq
aaacctacgccttcttcttcctc

SEQ ID NO: 653 - DNA, 24 bp, Glycine max
  Clone ID: 318O13_region_A3__180013_12_Forward_Primer_Seq
accagtactcctggagggtctcac

SEQ ID NO: 654 - DNA, 23 bp, Glycine max
  Clone ID: 318O13_region_A3__180013_12_Reverse_Primer_Seq
ctggtgctcctgcaacatcttct

SEQ ID NO: 655 - DNA, 25 bp, Glycine max
  Clone ID: 318O13_region_A3__171606_14_Forward_Primer_Seq
gcaactcgacatattctttgggatt

SEQ ID NO: 656 - DNA, 25 bp, Glycine max
  Clone ID: 318O13_region_A3__171606_14_Reverse_Primer_Seq
ctttccaatgtgggactgaagaagt

SEQ ID NO: 657 - DNA, 24 bp, Glycine max
  Clone ID: 318O13_region_A3__416256_13_Forward_Primer_Seq
aacaattgcatccggtcattctaa

SEQ ID NO: 658 - DNA, 25 bp, Glycine max
  Clone ID: 318O13_region_A3__416256_13_Reverse_Primer_Seq
aattctcacactcaagaggccagac

SEQ ID NO: 659 - DNA, 25 bp, Glycine max
  Clone ID: 318O13_region_A3__231395_15_Forward_Primer_Seq
gtccttcccgcactaatttatcgaa

SEQ ID NO: 660 - DNA, 24 bp, Glycine max
  Clone ID: 318O13_region_A3__231395_15_Reverse_Primer_Seq
gatcacccatcaaaccctaccttc

SEQ ID NO: 661 - DNA, 25 bp, Glycine max
  Clone ID: 318O13_region_A3__5502_47Forward_Primer_Seq
cagcaagagttgacgaatgatgaac

SEQ ID NO: 662 - DNA, 25 bp, Glycine max
  Clone ID: 318O13_region_A3__5502_47_Reverse_Primer_Seq
gctttaacaccgacaacctcatacc

SEQ ID NO: 663 - DNA, 25 bp, Glycine max
  Clone ID: 318O13_region_A3__93061_14_Forward_Primer_Seq
acagcatcagaactcagaagcattg

SEQ ID NO: 664 - DNA, 23 bp, Glycine max
  Clone ID: 318O13_region_A3__93061_14_Reverse_Primer_Seq
gaggctaacgttgttgctgacct

SEQ ID NO: 665 - DNA, 25 bp, Glycine max
  Clone ID: 318O13_region_A3__111684_19_Forward_Primer_Seq
cttctccataacacttcccaccaac

SEQ ID NO: 666 - DNA, 25 bp, Glycine max
  Clone ID: 318O13_region_A3__111684_19_Reverse_Primer_Seq
tcgtgaggagaaggaagagagaaag

SEQ ID NO: 667 - DNA, 24 bp, Glycine max
  Clone ID: 318O13_region_A3__69328_14_Forward_Primer_Seq
ctcctcagccaggttacgcttatt

SEQ ID NO: 668 - DNA, 25 bp, Glycine max
  Clone ID: 318O13_region_A3__69328_14_Reverse_Primer_Seq
ccaaacgcgagagagaaataaagaa

SEQ ID NO: 669 - DNA, 25 bp, Glycine max
  Clone ID: 318O13_region_A3__36529_17_Forward_Primer_Seq
tcagagacttctttgcttggatgaa

SEQ ID NO: 670 - DNA, 25 bp, Glycine max
  Clone ID: 318O13_region_A3__36529_17_Reverse_Primer_Seq
caactacaggaaacgatgcaaacaa

SEQ ID NO: 671 - DNA, 25 bp, Glycine max
  Clone ID: 318O13_region_A3__139128_12_Forward_Primer_Seq
cagttcggcgatatctgattctacc

SEQ ID NO: 672 - DNA, 25 bp, Glycine max
  Clone ID: 318O13_region_A3__139128_12_Reverse_Primer_Seq
ccagtgaagttcttgaaccttgtca

SEQ ID NO: 673 - DNA, 25 bp, Glycine max
  Clone ID: 318O13_region_A3__495674_13_Forward_Primer_Seq
aagaatccaggaccatgaccctatt

SEQ ID NO: 674 - DNA, 25 bp, Glycine max
  Clone ID: 318O13_region_A3__495674_13_Reverse_Primer_Seq
tttgcggtcattctctgatgttatt

SEQ ID NO: 675 - DNA, 25 bp, Glycine max
  Clone ID: 318O13_region_A3__187577_13_Forward_Primer_Seq
aaacgaacacatacgcactcacatt

SEQ ID NO: 676 - DNA, 24 bp, Glycine max
  Clone ID: 318O13_region_A3__187577_13_Reverse_Primer_Seq
cttactggatccatgaacggtgga

SEQ ID NO: 677 - DNA, 25 bp, Glycine max
  Clone ID: 318O13_region_A3__453036_14_Forward_Primer_Seq
caacaatccgtgttgataagagcaa

SEQ ID NO: 678 - DNA, 25 bp, Glycine max
  Clone ID: 318O13_region_A3__453036_14_Reverse_Primer_Seq
ccctaaagcacttctagtcccgaaa

SEQ ID NO: 679 - DNA, 25 bp, Glycine max
  Clone ID: 318O13_region_A3__374041_13_Forward_Primer_Seq
aatgcaaagtaacaaagcaccctgt

SEQ ID NO: 680 - DNA, 25 bp, Glycine max
  Clone ID: 318O13_region_A3__374041_13_Reverse_Primer_Seq
tttgttccaccatgaataatgacca

SEQ ID NO: 681 - DNA, 23 bp, Glycine max
  Clone ID: 318O13_region_A3__3412_11__Forward_Primer_Seq
aaacactccaatgccaccatctc

SEQ ID NO: 682 - DNA, 25 bp, Glycine max
  Clone ID: 318O13_region_A3__3412_11_Reverse_Primer_Seq
aaccttaaccaaagccaacaccttt

SEQ ID NO: 683 - DNA, 24 bp, Glycine max
  Clone ID: 318O13_region_A3__276495_28_Forward_Primer_Seq
ctttcaagccgcagggttagatac

SEQ ID NO: 684 - DNA, 25 bp, Glycine max
  Clone ID: 318O13_region_A3__276495_28_Reverse_Primer_Seq
agctgcaacgtgtagccaattatta

SEQ ID NO: 685 - DNA, 25 bp, Glycine max
  Clone ID: 318O13_region_A3__151839_17_Forward_Primer_Seq
ccgcaatggtatctctctcagactt

SEQ ID NO: 686 - DNA, 25 bp, Glycine max
  Clone ID: 318O13_region_A3__151839_17_Reverse_Primer_Seq
caggaagaggaagaggaggaagaag

SEQ ID NO: 687 - DNA, 25 bp, Glycine max
  Clone ID: 318O13_region_A3__292912_12_Forward_Primer_Seq
atatgtttgcgtttctgtgcttgtg

SEQ ID NO: 688 - DNA, 25 bp, Glycine max
  Clone ID: 318O13_region_A3__292912_12_Reverse_Primer_Seq
cccttaggaatagagagaaagagca

SEQ ID NO: 689 - DNA, 25 bp, Glycine max
  Clone ID: 318O13_region_A3__104560_12_Forward_Primer_Seq
aagagacaaatggaggaaattgcac

SEQ ID NO: 690 - DNA, 25 bp, Glycine max
  Clone ID: 318O13_region_A3__104560_12_Reverse_Primer_Seq
ccacttctccaattcctctctgaaa

SEQ ID NO: 691 - DNA, 25 bp, Glycine max
  Clone ID: 318O13_region_A3__65193_11__Forward_Primer_Seq
tagtggaatggaagcagaacagagg

SEQ ID NO: 692 - DNA, 25 bp, Glycine max
  Clone ID: 318O13_region_A3__65193_11_Reverse_Primer_Seq
tatgctgttcttccaaaccaggagt

SEQ ID NO: 693 - DNA, 27 bp, Glycine max
  Clone ID: 318O13_region_A3__110573_70_Forward_Primer_Seq
cacattgaaataaacatgtacgacaca

SEQ ID NO: 694 - DNA, 27 bp, Glycine max
  Clone ID: 318O13_region_A3__110573_70_Reverse_Primer_Seq
cgctggatataatatttatgtgtgctg

SEQ ID NO: 695 - DNA, 25 bp, Glycine max
  Clone ID: 318O13_region_A3__65117_12_Forward_Primer_Seq
tgcagtgtgagttcttctttgatcc

SEQ ID NO: 696 - DNA, 25 bp, Glycine max
  Clone ID: 318O13_region_A3__65117_12_Reverse_Primer_Seq
tctgttctgcttccattccactaaa

SEQ ID NO: 697 - DNA, 25 bp, Glycine max
  Clone ID: 318O13_region_A3__490837_16_Forward_Primer_Seq
agagaacgaacggtagcattctcag

SEQ ID NO: 698 - DNA, 25 bp, Glycine max
  Clone ID: 318O13_region_A3__490837_16_Reverse_Primer_Seq
acatgcattgtgtgttgactttcct

SEQ ID NO: 699 - DNA, 27 bp, Glycine max
  Clone ID: 318O13_region_A3__107448_11_Forward_Primer_Seq
tcagaaagtttccctacttgattgagg

SEQ ID NO: 700 - DNA, 25 bp, Glycine max
  Clone ID: 318O13_region_A3__107448_11_Reverse_Primer_Seq
tccttcgatcaatttctggtttgat

SEQ ID NO: 701 - DNA, 26 bp, Glycine max
  Clone ID: 318O13_region_A3__331_23_Forward_Primer_Seq
ccattgtccatcctctctaatgtttc

SEQ ID NO: 702 - DNA, 25 bp, Glycine max
  Clone ID: 318O13_region_A3__331_23_Reverse_Primer_Seq
tttcacatgtccagtgttggattta

SEQ ID NO: 703 - DNA, 25 bp, Glycine max
  Clone ID: 318O13_region_A3__193470_13_Forward_Primer_Seq
taggcatagcttaaggcatggtatt

SEQ ID NO: 704 - DNA, 25 bp, Glycine max
  Clone ID: 318O13_region_A3__193470_13_Reverse_Primer_Seq
cctcatgtccttcctgcttctcata

SEQ ID NO: 705 - DNA, 25 bp, Glycine max
  Clone ID: 318O13_region_A3__183305_14_Forward_Primer_Seq
ggagattaatttgatgaaccgacca

SEQ ID NO: 706 - DNA, 25 bp, Glycine max
  Clone ID: 318O13_region_A3__183305_14_Reverse_Primer_Seq
acagggtgagaccaacacaaagatt

SEQ ID NO: 707 - DNA, 25 bp, Glycine max
  Clone ID: 318O13_region_A3__55050_14_Forward_Primer_Seq
tctgacccttaataatcaggcaaca

SEQ ID NO: 708 - DNA, 25 bp, Glycine max
  Clone ID: 318O13_region_A3__55050_14_Reverse_Primer_Seq
agaatcttctacttgcccggttaga

SEQ ID NO: 709 - DNA, 27 bp, Glycine max
  Clone ID: 318O13_region_A3__224693_21_Forward_Primer_Seq
tggtgctaagaaagtgtaatttgtgga

SEQ ID NO: 710 - DNA, 25 bp, Glycine max
  Clone ID: 318O13_region_A3__224693_21_Reverse_Primer_Seq
tttctttcaaacatgtggtgtaccg

SEQ ID NO: 711 - DNA, 25 bp, Glycine max
  Clone ID: 318O13_region_A3__207216_12_Forward_Primer_Seq
ttaactttgttagaggaggcggaga

SEQ ID NO: 712 - DNA, 24 bp, Glycine max
  Clone ID: 318O13_region_A3__207216_12_Reverse_Primer_Seq
ctggctcgttgtcttcttcatgtt

SEQ ID NO: 713 - DNA, 25 bp, Glycine max
  Clone ID: 318O13_region_A3__4654_22_Forward_Primer_Seq
ctgaagaaagcattgaccaaggaaa

SEQ ID NO: 714 - DNA, 25 bp, Glycine max
  Clone ID: 318O13_region_A3__4654_22_Reverse_Primer_Seq
aacccatcttaacccacaatcacag

SEQ ID NO: 715 - DNA, 25 bp, Glycine max
  Clone ID: 318O13_region_A3__408959_13_Forward_Primer_Seq
cggttgttggaagaagttgttgtta

SEQ ID NO: 716 - DNA, 25 bp, Glycine max
  Clone ID: 318O13_region_A3__408959_13_Reverse_Primer_Seq
gtgtagttagcgtggtctgcttgtg

SEQ ID NO: 717 - DNA, 25 bp, Glycine max
  Clone ID: 318O13_region_A3__132288_22_Forward_Primer_Seq
acaggtcatctaaccaattgcatgt

SEQ ID NO: 718 - DNA, 25 bp, Glycine max
  Clone ID: 318O13_region_A3__132288_22_Reverse_Primer_Seq
gttgcttatgtcttggacaccattg

SEQ ID NO: 719 - DNA, 25 bp, Glycine max
  Clone ID: 318O13_region_A3__292822_20_Forward_Primer_Seq
gctattcacaaagcaagagccgtta

SEQ ID NO: 720 - DNA, 25 bp, Glycine max
  Clone ID: 318O13_region_A3__292822_20_Reverse_Primer_Seq
agcacagaaacgcaaacatataccc

SEQ ID NO: 721 - DNA, 25 bp, Glycine max
  Clone ID: 318O13_region_A3__311076_12_Forward_Primer_Seq
tttgtacttcgcacacatttgaagg

SEQ ID NO: 722 - DNA, 24 bp, Glycine max
  Clone ID: 318O13_region_A3__311076_12_Reverse_Primer_Seq
tttcctctcctacccaaggtgagt

SEQ ID NO: 723 - DNA, 25 bp, Glycine max
  Clone ID: 318O13_region_A3__509623_13_Forward_Primer_Seq
aatgagcatagcgaagcctcctaaa

SEQ ID NO: 724 - DNA, 25 bp, Glycine max
  Clone ID: 318O13_region_A3__509623_13_Reverse_Primer_Seq
tcgatggaaaccctagatctcactc

SEQ ID NO: 725 - DNA, 25 bp, Glycine max
  Clone ID: 318O13_region_A3__190404_14_Forward_Primer_Seq
aatctggtccctcaaagaacaagtg

SEQ ID NO: 726 - DNA, 25 bp, Glycine max
  Clone ID: 318O13_region_A3__190404_14_Reverse_Primer_Seq
tttcccttatgcaagaagtttggtg

SEQ ID NO: 727 - DNA, 25 bp, Glycine max
  Clone ID: 318O13_region_A3__164916_15_Forward_Primer_Seq
aggctacggtatagaccacgttgaa

SEQ ID NO: 728 - DNA, 25 bp, Glycine max
  Clone ID: 318O13_region_A3__164916_15_Reverse_Primer_Seq
gaatggaattgatctttccagaacc

SEQ ID NO: 729 - DNA, 26 bp, Glycine max
  Clone ID: 318O13_region_A3__21028_13_Forward_Primer_Seq
gatggataattagtcttggccatcat

SEQ ID NO: 730 - DNA, 25 bp, Glycine max
  Clone ID: 318O13_region_A3__21028_13_Reverse_Primer_Seq
tattcctttgagcaagcaactttga

SEQ ID NO: 731 - DNA, 25 bp, Glycine max
  Clone ID: 318O13_region_A3__208012_17_Forward_Primer_Seq
gttacaacagctacctccgcagact

SEQ ID NO: 732 - DNA, 20 bp, Glycine max
  Clone ID: 318O13_region_A3__208012_17_Reverse_Primer_Seq
agtggcggacctgattctcc

SEQ ID NO: 733 - DNA, 25 bp, Glycine max
  Clone ID: 318O13_region_A3__484089_14_Forward_Primer_Seq
cgatcgcatgatagagttcaccaat

SEQ ID NO: 734 - DNA, 25 bp, Glycine max
  Clone ID: 318O13_region_A3__484089_14_Reverse_Primer_Seq
actacgatggcctctcctacgtttc

SEQ ID NO: 735 - DNA, 25 bp, Glycine max
  Clone ID: 318O13_region_A3__332780_17_Forward_Primer_Seq
gttacaacagctacctccgcagact

SEQ ID NO: 736 - DNA, 20 bp, Glycine max
  Clone ID: 318O13_region_A3__332780_17_Reverse_Primer_Seq
agtggcggacctgattctcc

SEQ ID NO: 737 - DNA, 26 bp, Glycine max
  Clone ID: 318O13_region_A3__480137_37_Forward_Primer_Seq
ttcaagggaaggagaagaatagattt

SEQ ID NO: 738 - DNA, 27 bp, Glycine max
  Clone ID: 318O13_region_A3__480137_37_Reverse_Primer_Seq
tccctattaagtttcctttaatccatc

SEQ ID NO: 739 - DNA, 25 bp, Glycine max
  Clone ID: 318O13_region_A3__441056_14_Forward_Primer_Seq
ctaatttgcgaacaggccacaagta

SEQ ID NO: 740 - DNA, 24 bp, Glycine max
  Clone ID: 318O13_region_A3__441056_14_Reverse_Primer_Seq
gattacgaaatttcttggcggaag

SEQ ID NO: 741 - DNA, 25 bp, Glycine max
  Clone ID: 318O13_region_A3__77486_11_Forward_Primer_Seq
atacccaaatcccatcttccatttc

SEQ ID NO: 742 - DNA, 25 bp, Glycine max
  Clone ID: 318O13_region_A3__77486_11_Reverse_Primer_Seq
gttgtgagcagaactaggagccatt

SEQ ID NO: 743 - DNA, 25 bp, Glycine max
  Clone ID: 318O13_region_A3__272468_11_Forward_Primer_Seq
attggatccatcctataaggcaggt

SEQ ID NO: 744 - DNA, 25 bp, Glycine max
  Clone ID: 318O13_region_A3__272468_11_Reverse_Primer_Seq
ttgtacgttgcatcagtaacacgaa

SEQ ID NO: 745 - DNA, 25 bp, Glycine max
  Clone ID: 318O13_region_A3__425319_17_Forward_Primer_Seq
taccagtgaaggatgaggtgactgt

SEQ ID NO: 746 - DNA, 25 bp, Glycine max
  Clone ID: 318O13_region_A3__425319_17_Reverse_Primer_Seq
tgaagcatactaagggcgtatccat

SEQ ID NO: 747 - DNA, 25 bp, Glycine max
  Clone ID: 318O13_region_A3__413879_31_Forward_Primer_Seq
gatcctcagccttagtttgctgaga

SEQ ID NO: 748 - DNA, 25 bp, Glycine max
  Clone ID: 318O13_region_A3__413879_31_Reverse_Primer_Seq
tgtcctgtaatctgtcaccataggc

SEQ ID NO: 749 - DNA, 25 bp, Glycine max
  Clone ID: 318O13_region_A3__80477_64_Forward_Primer_Seq
ggttggcctgaataatttgcaatag

SEQ ID NO: 750 - DNA, 25 bp, Glycine max
  Clone ID: 318O13_region_A3__80477_64_Reverse_Primer_Seq
gggaagtgggatagttgatagcaga

SEQ ID NO: 751 - DNA, 25 bp, Glycine max
  Clone ID: 318O13_region_A3__277272_50_Forward_Primer_Seq
cctgatggtactcgcttctctctct

SEQ ID NO: 752 - DNA, 25 bp, Glycine max
  Clone ID: 318O13_region_A3__277272_50_Reverse_Primer_Seq
tctgtcattgaacatgcacaacatt

SEQ ID NO: 753 - DNA, 25 bp, Glycine max
  Clone ID: 318O13_region_A3__509642_13_Forward_Primer_Seq
ctaaacgctttggtttcttcaccac

SEQ ID NO: 754 - DNA, 25 bp, Glycine max
  Clone ID: 318O13_region_A3__509642_13_Reverse_Primer_Seq
tcgatcaatatcctctctccgaatc

SEQ ID NO: 755 - DNA, 25 bp, Glycine max
  Clone ID: 318O13_region_A3__321771_14_Forward_Primer_Seq
atcaaactctggaaacaggttggtg

SEQ ID NO: 756 - DNA, 25 bp, Glycine max
  Clone ID: 318O13_region_A3__321771_14_Reverse_Primer_Seq
gtcagcaacaccttggaattaatgg

SEQ ID NO: 757 - DNA, 25 bp, Glycine max
  Clone ID: 318O13_region_A3__26788_12_Forward_Primer_Seq
gaagagacaattgtgaggcaaatca

SEQ ID NO: 758 - DNA, 25 bp, Glycine max
  Clone ID: 318O13_region_A3__26788_12_Reverse_Primer_Seq
cagaccaatcatggttctctgctta

SEQ ID NO: 759 - DNA, 25 bp, Glycine max
  Clone ID: 318O13_region_A3__262706_16_Forward_Primer_Seq
ttccttatcacccaacatccaaact

SEQ ID NO: 760 - DNA, 25 bp, Glycine max
  Clone ID: 318O13_region_A3__262706_16_Reverse_Primer_Seq
acactaggagtgcgggaaataaatg

SEQ ID NO: 761 - DNA, 25 bp, Glycine max
  Clone ID: 318O13_region_A3__243928_16_Forward_Primer_Seq
tggcatgtgaaacctaaataaacaa

SEQ ID NO: 762 - DNA, 25 bp, Glycine max
  Clone ID: 318O13_region_A3__243928_16_Reverse_Primer_Seq
tatcagggtatgcctgggaagataa

SEQ ID NO: 763 - DNA, 25 bp, Glycine max
  Clone ID: 318O13_region_A3__23246_148_Forward_Primer_Seq
aatcacctttctctgtccacctctg

SEQ ID NO: 764 - DNA, 25 bp, Glycine max
  Clone ID: 318O13_region_A3__23246_148_Reverse_Primer_Seq
aaggctcaaatttgtaagccaatca

SEQ ID NO: 765 - DNA, 25 bp, Glycine max
  Clone ID: 318O13_region_A3__165406_12_Forward_Primer_Seq
ggcactgagctgaattgtaatgttg

SEQ ID NO: 766 - DNA, 25 bp, Glycine max
  Clone ID: 318O13_region_A3__165406_12_Reverse_Primer_Seq
ccttgtcgatctctttaaccctaag

SEQ ID NO: 767 - DNA, 25 bp, Glycine max
  Clone ID: 318O13_region_A3__486294_14_Forward_Primer_Seq
cttatggccatgctatacacatgct

SEQ ID NO: 768 - DNA, 25 bp, Glycine max
  Clone ID: 318O13_region_A3__486294_14_Reverse_Primer_Seq
actgaagtgctttccatgatccatt

SEQ ID NO: 769 - DNA, 25 bp, Glycine max
  Clone ID: 318O13_region_A3__46754_12_Forward_Primer_Seq
aatccaaagttgtcaagatggttcc

SEQ ID NO: 770 - DNA, 25 bp, Glycine max
  Clone ID: 318O13_region_A3__46754_12_Reverse_Primer_Seq
tcattgtcggatcgttagatttgaa

SEQ ID NO: 771 - DNA, 25 bp, Glycine max
  Clone ID: 318O13_region_A3__381116_15_Forward_Primer_Seq
aaaggtgggtgtgcttcccatttat

SEQ ID NO: 772 - DNA, 25 bp, Glycine max
  Clone ID: 318O13_region_A3__381116_15_Reverse_Primer_Seq
ccattcattctcagatgctccatta

SEQ ID NO: 773 - DNA, 25 bp, Glycine max
  Clone ID: 318O13_region_A3__350369_11_Forward_Primer_Seq
aaaggttgaagaagatgctgcgtaa

SEQ ID NO: 774 - DNA, 25 bp, Glycine max
  Clone ID: 318O13_region_A3__350369_11_Reverse_Primer_Seq
tcacgttgaacggtttgaaatactc

SEQ ID NO: 775 - DNA, 25 bp, Glycine max
  Clone ID: 318O13_region_A3__138841_13_Forward_Primer_Seq
ggtgcagcttaaacaatttctgtca

SEQ ID NO: 776 - DNA, 25 bp, Glycine max
  Clone ID: 318O13_region_A3__138841_13_Reverse_Primer_Seq
tttgaatacgttggagagcttggat

SEQ ID NO: 777 - DNA, 25 bp, Glycine max
  Clone ID: 318O13_region_A3__12158_142_Forward_Primer_Seq
cataccctttcagagtccctgtcac

SEQ ID NO: 778 - DNA, 25 bp, Glycine max
  Clone ID: 318O13_region_A3__12158_142_Reverse_Primer_Seq
tggaggaagtatgaaattcgtttcg

SEQ ID NO: 779 - DNA, 25 bp, Glycine max
  Clone ID: 318O13_region_A3__315368_13_Forward_Primer_Seq
cagtcagagaaaggaagcatgcact

SEQ ID NO: 780 - DNA, 25 bp, Glycine max
  Clone ID: 318O13_region_A3__315368_13_Reverse_Primer_Seq
ctggagcaaaggatgaaagtgaagt

SEQ ID NO: 781 - DNA, 25 bp, Glycine max
  Clone ID: 318O13_region_A3__307549_13_Forward_Primer_Seq
ctggagcaaaggatgaaagtgaagt

SEQ ID NO: 782 - DNA, 25 bp, Glycine max
  Clone ID: 318O13_region_A3__307549_13_Reverse_Primer_Seq
cagtcagagaaaggaagcatgcact

SEQ ID NO: 783 - DNA, 25 bp, Glycine max
  Clone ID: 318O13_region_A3__159857_14_Forward_Primer_Seq
tcctcctcctagttgtgcttctctt

SEQ ID NO: 784 - DNA, 25 bp, Glycine max
  Clone ID: 318O13_region_A3__159857_14_Reverse_Primer_Seq
aaggatatgctgaccgcaatctaat

SEQ ID NO: 785 - DNA, 25 bp, Glycine max
  Clone ID: 318O13_region_A3__140551_15_Forward_Primer_Seq
gattcctggttcttggaatttcctt

SEQ ID NO: 786 - DNA, 25 bp, Glycine max
  Clone ID: 318O13_region_A3__140551_15_Reverse_Primer_Seq
caaacgcataccagatgacaataca

SEQ ID NO: 787 - DNA, 25 bp, Glycine max
  Clone ID: 318O13_region_A3__279869_11_Forward_Primer_Seq
taatgtgccaacttctagcaaggat

SEQ ID NO: 788 - DNA, 25 bp, Glycine max
  Clone ID: 318O13_region_A3__279869_11_Reverse_Primer_Seq
agtctgggcttatggccaaatttat

SEQ ID NO: 789 - DNA, 27 bp, Glycine max
  Clone ID: 318O13_region_A3__78292_35_Forward_Primer_Seq
caaattgattagtttctttccttctcc

SEQ ID NO: 790 - DNA, 26 bp, Glycine max
  Clone ID: 318O13_region_A3__78292_35_Reverse_Primer_Seq
catgttctttcatcaagaatcaatgc

SEQ ID NO: 791 - DNA, 25 bp, Glycine max
  Clone ID: 318O13_region_A3__185019_12_Forward_Primer_Seq
aaccttctcgcgtagcttgagtaga

SEQ ID NO: 792 - DNA, 25 bp, Glycine max
  Clone ID: 318O13_region_A3__185019_12_Reverse_Primer_Seq
tcatgctcaccaatgctctcataat

SEQ ID NO: 793 - DNA, 25 bp, Glycine max
  Clone ID: 318O13_region_A3__409164_13_Forward_Primer_Seq
aggagaaacatcagcatcattacgg

SEQ ID NO: 794 - DNA, 22 bp, Glycine max
  Clone ID: 318O13_region_A3__409164_13_Reverse_Primer_Seq
aaagggtgggtgcatgaagaaa

SEQ ID NO: 795 - DNA, 25 bp, Glycine max
  Clone ID: 318O13_region_A3__75392_14_Forward_Primer_Seq
gaaggagcctcatcattgacctaag

SEQ ID NO: 796 - DNA, 25 bp, Glycine max
  Clone ID: 318O13_region_A3__75392_14_Reverse_Primer_Seq
cgatgacattgatggttgatatcgt

SEQ ID NO: 797 - DNA, 25 bp, Glycine max
  Clone ID: 318O13_region_A3__231320_12_Forward_Primer_Seq
ccctaacaatcatttcaacgccttt

SEQ ID NO: 798 - DNA, 25 bp, Glycine max
  Clone ID: 318O13_region_A3__231320_12_Reverse_Primer_Seq
gccacgaatcgctgataaataaaga

SEQ ID NO: 799 - DNA, 24 bp, Glycine max
  Clone ID: 318O13_region_A3__381102_14_Forward_Primer_Seq
ggccactgagaaacatgttcgata

SEQ ID NO: 800 - DNA, 26 bp, Glycine max
  Clone ID: 318O13_region_A3__381102_14_Reverse_Primer_Seq
caaagttatctttcctctggaaacca

SEQ ID NO: 801 - DNA, 25 bp, Glycine max
  Clone ID: 318O13_region_A3__491826_15_Forward_Primer_Seq
cttgtggcgatggtcctctttaata

SEQ ID NO: 802 - DNA, 24 bp, Glycine max
  Clone ID: 318O13_region_A3__491826_15_Reverse_Primer_Seq
gaccaatcttcacaatcccacaaa

SEQ ID NO: 803 - DNA, 25 bp, Glycine max
  Clone ID: 318O13_region_A3__56365_21_Forward_Primer_Seq
catgttctccacaaggaaacagaga

SEQ ID NO: 804 - DNA, 25 bp, Glycine max
  Clone ID: 318O13_region_A3__56365_21_Reverse_Primer_Seq
ccatgactacagtttcaggcacaac

SEQ ID NO: 805 - DNA, 25 bp, Glycine max
  Clone ID: 318O13_region_A3__372628_15_Forward_Primer_Seq
aaaggaaatctgaaatcctgtggaa

SEQ ID NO: 806 - DNA, 25 bp, Glycine max
  Clone ID: 318O13_region_A3__372628_15_Reverse_Primer_Seq
gggttgttacttggctgatagatgg

SEQ ID NO: 807 - DNA, 25 bp, Glycine max
  Clone ID: 318O13_region_A3__217037_11_Forward_Primer_Seq
ggatctcttcaacactgaccatcct

SEQ ID NO: 808 - DNA, 25 bp, Glycine max
  Clone ID: 318O13_region_A3__217037_11_Reverse_Primer_Seq
cctacccacttcaagttcaactgtc

SEQ ID NO: 809 - DNA, 25 bp, Glycine max
  Clone ID: 318O13_region_A3__302609_11_Forward_Primer_Seq
cctacccacttcaagttcaactgtc

SEQ ID NO: 810 - DNA, 25 bp, Glycine max
  Clone ID: 318O13_region_A3__302609_11_Reverse_Primer_Seq
ggatctcttcaacactgaccatcct

SEQ ID NO: 811 - DNA, 25 bp, Glycine max
  Clone ID: 318O13_region_A3__341804_11_Forward_Primer_Seq
ggatctcttcaacactgaccatcct

SEQ ID NO: 812 - DNA, 25 bp, Glycine max
  Clone ID: 318O13_region_A3__341804_11_Reverse_Primer_Seq
cctacccacttcaagttcaactgtc

SEQ ID NO: 813 - DNA, 25 bp, Glycine max
  Clone ID: 318O13_region_A3__264929_68_Forward_Primer_Seq
agctaaagcaaaggtgggtttgtaa

SEQ ID NO: 814 - DNA, 25 bp, Glycine max
  Clone ID: 318O13_region_A3__264929_68_Reverse_Primer_Seq
gcgtgattgttctttatgcattgtt

SEQ ID NO: 815 - DNA, 25 bp, Glycine max
  Clone ID: 318O13_region_A3__55499_12__Forward_Primer_Seq
ttgctgcaaggtttcactctaattg

SEQ ID NO: 816 - DNA, 25 bp, Glycine max
  Clone ID: 318O13_region_A3__55499_12_Reverse_Primer_Seq
aagaattatgtcaatgctcctagcc

SEQ ID NO: 817 - DNA, 25 bp, Glycine max
  Clone ID: 318O13_region_A3__295634_14_Forward_Primer_Seq
taagttcgttggtttgccttgattt

SEQ ID NO: 818 - DNA, 26 bp, Glycine max
  Clone ID: 318O13_region_A3__295634_14_Reverse_Primer_Seq
tttgtcaaatccgactcaatttattt

SEQ ID NO: 819 - DNA, 25 bp, Glycine max
  Clone ID: 318O13_region_A3__269358_15_Forward_Primer_Seq
ttcatgatggttaggtcttgtgcag

SEQ ID NO: 820 - DNA, 25 bp, Glycine max
  Clone ID: 318O13_region_A3__269358_15_Reverse_Primer_Seq
gagtgtagtgcatgatgtgaggcta

SEQ ID NO: 821 - DNA, 25 bp, Glycine max
  Clone ID: 318O13_region_A3__457009_24_Forward_Primer_Seq
tgctgccattggagaaagttgttat

SEQ ID NO: 822 - DNA, 25 bp, Glycine max
  Clone ID: 318O13_region_A3__457009_24_Reverse_Primer_Seq
ggcttctattccctcaactcaccat

SEQ ID NO: 823 - DNA, 25 bp, Glycine max
  Clone ID: 318O13_region_A3__176598_14_Forward_Primer_Seq
ttcactataaaggatccgttcagca

SEQ ID NO: 824 - DNA, 25 bp, Glycine max
  Clone ID: 318O13_region_A3__176598_14_Reverse_Primer_Seq
tgttggtaaagagtggcaacaagaa

SEQ ID NO: 825 - DNA, 25 bp, Glycine max
  Clone ID: 318O13_region_A3__278266_12_Forward_Primer_Seq
tcttaatggccaattgctgaaagtt

SEQ ID NO: 826 - DNA, 27 bp, Glycine max
  Clone ID: 318O13_region_A3__278266_12_Reverse_Primer_Seq
cccattaatataacaaagtcaacatgg

SEQ ID NO: 827 - DNA, 25 bp, Glycine max
  Clone ID: 318O13_region_A3__391810_12_Forward_Primer_Seq
aaggaggttggaggaaatcatcaag

SEQ ID NO: 828 - DNA, 26 bp, Glycine max
  Clone ID: 318O13_region_A3__391810_12_Reverse_Primer_Seq
cacttactgtgcacaatttgattctc

SEQ ID NO: 829 - DNA, 25 bp, Glycine max
  Clone ID: 318O13_region_A3__269485_15_Forward_Primer_Seq
agcctcacatcatgcactacactct

SEQ ID NO: 830 - DNA, 25 bp, Glycine max
  Clone ID: 318O13_region_A3__269485_15_Reverse_Primer_Seq
tccctcacttatgacaccactcatc

SEQ ID NO: 831 - DNA, 26 bp, Glycine max
  Clone ID: 318O13_region_A3__359247_17_Forward_Primer_Seq
ggttgagaaggagagtttaagggttg

SEQ ID NO: 832 - DNA, 25 bp, Glycine max
  Clone ID: 318O13_region_A3__359247_17_Reverse_Primer_Seq
ttcactcccaattgtcatacaaaca

SEQ ID NO: 833 - DNA, 27 bp, Glycine max
  Clone ID: 318O13_region_A3__315094_13_Forward_Primer_Seq
tccatataatggacaggatatctgaat

SEQ ID NO: 834 - DNA, 26 bp, Glycine max
  Clone ID: 318O13_region_A3__315094_13_Reverse_Primer_Seq
aaatgtcacgaggaaattatttgttt

SEQ ID NO: 835 - DNA, 26 bp, Glycine max
  Clone ID: 318O13_region_A3__307823_13_Forward_Primer_Seq
aaatgtcacgaggaaattatttgttt

SEQ ID NO: 836 - DNA, 27 bp, Glycine max
  Clone ID: 318O13_region_A3__307823_13_Reverse_Primer_Seq
tccatataatggacaggatatctgaat

SEQ ID NO: 837 - DNA, 25 bp, Glycine max
  Clone ID: 318O13_region_A3__248588_15_Forward_Primer_Seq
gtctgcaagctaacagtgtcagagg

SEQ ID NO: 838 - DNA, 26 bp, Glycine max
  Clone ID: 318O13_region_A3__248588_15_Reverse_Primer_Seq
gaattcccacttagtcattaccacga

SEQ ID NO: 839 - DNA, 26 bp, Glycine max
  Clone ID: 318O13_region_A3__252426_85_Forward_Primer_Seq
tcaattcaatgataaagtcctttgga

SEQ ID NO: 840 - DNA, 26 bp, Glycine max
  Clone ID: 318O13_region_A3__252426_85_Reverse_Primer_Seq
tggtttgcttaggtagaacaagaaat

SEQ ID NO: 841 - DNA, 25 bp, Glycine max
  Clone ID: 318O13_region_A3__513314_16_Forward_Primer_Seq
cttaaagtgcgttatcgtcagcgta

SEQ ID NO: 842 - DNA, 25 bp, Glycine max
  Clone ID: 318O13_region_A3__513314_16_Reverse_Primer_Seq
actgatactgaccaaatgaccatgc

SEQ ID NO: 843 - DNA, 25 bp, Glycine max
  Clone ID: 318O13_region_A3__68183_14_Forward_Primer_Seq
caccgtgaagatgatcaagagagag

SEQ ID NO: 844 - DNA, 25 bp, Glycine max
  Clone ID: 318O13_region_A3__68183_14_Reverse_Primer_Seq
taggatagcccaccaacaaggataa

SEQ ID NO: 845 - DNA, 25 bp, Glycine max
  Clone ID: 318O13_region_A3__471191_13_Forward_Primer_Seq
cgtcacttgacctcaacaatgtgta

SEQ ID NO: 846 - DNA, 26 bp, Glycine max
  Clone ID: 318O13_region_A3__471191_13_Reverse_Primer_Seq
tgccaaattaatctcattatggtacg

SEQ ID NO: 847 - DNA, 25 bp, Glycine max
  Clone ID: 318O13_region_A3__163547_18_Forward_Primer_Seq
tttgcaaatcatgcatcctaagttt

SEQ ID NO: 848 - DNA, 25 bp, Glycine max
  Clone ID: 318O13_region_A3__163547_18_Reverse_Primer_Seq
tgaatgcacaagtgtatttgcagag

SEQ ID NO: 849 - DNA, 25 bp, Glycine max
  Clone ID: 318O13_region_A3__417867_15_Forward_Primer_Seq
gtttgggtctgaatctgaagaaacg

SEQ ID NO: 850 - DNA, 25 bp, Glycine max
  Clone ID: 318O13_region_A3__417867_15_Reverse_Primer_Seq
gcgaatctagcgtagttggtgaaat

SEQ ID NO: 851 - DNA, 25 bp, Glycine max
  Clone ID: 318O13_region_A3__332465_14_Forward_Primer_Seq
taacgctgcatgatttgagttctgt

SEQ ID NO: 852 - DNA, 25 bp, Glycine max
  Clone ID: 318O13_region_A3__332465_14_Reverse_Primer_Seq
ttggactttggagaccacattcttt

SEQ ID NO: 853 - DNA, 25 bp, Glycine max
  Clone ID: 318O13_region_A3__207697_14_Forward_Primer_Seq
taacgctgcatgatttgagttctgt

SEQ ID NO: 854 - DNA, 25 bp, Glycine max
  Clone ID: 318O13_region_A3__207697_14_Reverse_Primer_Seq
ttggactttggagaccacattcttt

SEQ ID NO: 855 - DNA, 25 bp, Glycine max
  Clone ID: 318O13_region_A3__277229_43_Forward_Primer_Seq
caagccaacatacacagtggttctg

SEQ ID NO: 856 - DNA, 25 bp, Glycine max
  Clone ID: 318O13_region_A3__277229_43_Reverse_Primer_Seq
tctgtcattgaacatgcacaacatt

SEQ ID NO: 857 - DNA, 23 bp, Glycine max
  Clone ID: 318O13_region_A3__36366_11__Forward_Primer_Seq
aattgtacggcagacacgtcctc

SEQ ID NO: 858 - DNA, 25 bp, Glycine max
  Clone ID: 318O13_region_A3__36366_11_Reverse_Primer_Seq
aaagaagtctctgacttgcctccac

SEQ ID NO: 859 - DNA, 25 bp, Glycine max
  Clone ID: 318O13_region_A3__91970_12__Forward_Primer_Seq
tctttggacactgtgagaggtgttt

SEQ ID NO: 860 - DNA, 26 bp, Glycine max
  Clone ID: 318O13_region_A3__91970_12_Reverse_Primer_Seq
tccatgattctattcgaccttaacaa

SEQ ID NO: 861 - DNA, 25 bp, Glycine max
  Clone ID: 318O13_region_A3__211533_11_Forward_Primer_Seq
ggtgtgttgggagagtcaacagtct

SEQ ID NO: 862 - DNA, 25 bp, Glycine max
  Clone ID: 318O13_region_A3__211533_11_Reverse_Primer_Seq
aaagggtatgagggtgggaatgaat

SEQ ID NO: 863 - DNA, 25 bp, Glycine max
  Clone ID: 318O13_region_A3__336301_11_Forward_Primer_Seq
ggtgtgttgggagagtcaacagtct

SEQ ID NO: 864 - DNA, 25 bp, Glycine max
  Clone ID: 318O13_region_A3__336301_11_Reverse_Primer_Seq
aaagggtatgagggtgggaatgaat

SEQ ID NO: 865 - DNA, 25 bp, Glycine max
  Clone ID: 318O13_region_A3__441603_14_Forward_Primer_Seq
gtggtagtccgcaatgagacaatct

SEQ ID NO: 866 - DNA, 25 bp, Glycine max
  Clone ID: 318O13_region_A3__441603_14_Reverse_Primer_Seq
aacatccattctcgaagaccaagtc

SEQ ID NO: 867 - DNA, 25 bp, Glycine max
  Clone ID: 318O13_region_A3__468354_15_Forward_Primer_Seq
tttcttactgcacctagtccacgac

SEQ ID NO: 868 - DNA, 25 bp, Glycine max
  Clone ID: 318O13_region_A3__468354_15_Reverse_Primer_Seq
gcctgaataatcggttaaagtaccg

SEQ ID NO: 869 - DNA, 25 bp, Glycine max
  Clone ID: 318O13_region_A3__188983_18_Forward_Primer_Seq
tgcgaattggtaacgatcttacttc

SEQ ID NO: 870 - DNA, 27 bp, Glycine max
  Clone ID: 318O13_region_A3__188983_18_Reverse_Primer_Seq
aattcatctaagttctgcgatgataaa

SEQ ID NO: 871 - DNA, 25 bp, Glycine max
  Clone ID: 318O13_region_A3__115502_17_Forward_Primer_Seq
gttattggtcggtgtacctgatcgt

SEQ ID NO: 872 - DNA, 25 bp, Glycine max
  Clone ID: 318O13_region_A3__115502_17_Reverse_Primer_Seq
ggagagttgacacagatgcataacg

SEQ ID NO: 873 - DNA, 25 bp, Glycine max
  Clone ID: 318O13_region_A3__163006_13_Forward_Primer_Seq
tgatggtaatgaatcagatcaacga

SEQ ID NO: 874 - DNA, 25 bp, Glycine max
  Clone ID: 318O13_region_A3__163006_13_Reverse_Primer_Seq
taaccacacgagattgcaacaaagt

SEQ ID NO: 875 - DNA, 26 bp, Glycine max
  Clone ID: 318O13_region_A3__119283_14_Forward_Primer_Seq
tgaagtggagtaaggtcttgtttgaa

SEQ ID NO: 876 - DNA, 25 bp, Glycine max
  Clone ID: 318O13_region_A3__119283_14_Reverse_Primer_Seq
taaacatgcaattgacagatgctga

SEQ ID NO: 877 - DNA, 25 bp, Glycine max
  Clone ID: 318O13_region_A3__491126_11_Forward_Primer_Seq
cctctctaccaaacacaagcagaaa

SEQ ID NO: 878 - DNA, 25 bp, Glycine max
  Clone ID: 318O13_region_A3__491126_11_Reverse_Primer_Seq
agctccactggtaagtccaattcac

SEQ ID NO: 879 - DNA, 25 bp, Glycine max
  Clone ID: 318O13_region_A3__99512_21__Forward_Primer_Seq
tatatcgtgcatgtttgttggctct

SEQ ID NO: 880 - DNA, 25 bp, Glycine max
  Clone ID: 318O13_region_A3__99512_21_Reverse_Primer_Seq
caagtcaccacccaaggaagtatct

SEQ ID NO: 881 - DNA, 26 bp, Glycine max
  Clone ID: 318O13_region_A3__280291_17_Forward_Primer_Seq
tgaaatcccaactataggttgacacc

SEQ ID NO: 882 - DNA, 25 bp, Glycine max
  Clone ID: 318O13_region_A3__280291_17_Reverse_Primer_Seq
gggactttctcccaacatttcattt

SEQ ID NO: 883 - DNA, 26 bp, Glycine max
  Clone ID: 318O13_region_A3__138443_19_Forward_Primer_Seq
tgataaagccaaagaagtaactttcg

SEQ ID NO: 884 - DNA, 24 bp, Glycine max
  Clone ID: 318O13_region_A3__138443_19_Reverse_Primer_Seq
ggttcatcaccttgtcacacctct

SEQ ID NO: 885 - DNA, 25 bp, Glycine max
  Clone ID: 318O13_region_A3__115973_14_Forward_Primer_Seq
ttaagcaattgagttggatgaggtg

SEQ ID NO: 886 - DNA, 25 bp, Glycine max
  Clone ID: 318O13_region_A3__115973_14_Reverse_Primer_Seq
atgattgttcaagtggtgcttcctc

SEQ ID NO: 887 - DNA, 26 bp, Glycine max
  Clone ID: 318O13_region_A3__329977_14_Forward_Primer_Seq
cagagagtcgtgtttaagcatttgaa

SEQ ID NO: 888 - DNA, 25 bp, Glycine max
  Clone ID: 318O13_region_A3__329977_14_Reverse_Primer_Seq
ggaaagccgaaggacatctattcta

SEQ ID NO: 889 - DNA, 26 bp, Glycine max
  Clone ID: 318O13_region_A3__205203_14_Forward_Primer_Seq
cagagagtcgtgtttaagcatttgaa

SEQ ID NO: 890 - DNA, 25 bp, Glycine max
  Clone ID: 318O13_region_A3__205203_14_Reverse_Primer_Seq
ggaaagccgaaggacatctattcta

SEQ ID NO: 891 - DNA, 25 bp, Glycine max
  Clone ID: 318O13_region_A3__153114_12_Forward_Primer_Seq
agttacaactttcgcatcggttaca

SEQ ID NO: 892 - DNA, 25 bp, Glycine max
  Clone ID: 318O13_region_A3__153114_12_Reverse_Primer_Seq
tgtcaggagagggtttaggaacaag

SEQ ID NO: 893 - DNA, 25 bp, Glycine max
  Clone ID: 318O13_region_A3__34581_13_Forward_Primer_Seq
gtacttgatcccagacaccacttgc

SEQ ID NO: 894 - DNA, 25 bp, Glycine max
  Clone ID: 318O13_region_A3__34581_13_Reverse_Primer_Seq
cgacaccgtatacgtaactccattg

SEQ ID NO: 895 - DNA, 25 bp, Glycine max
  Clone ID: 318O13_region_A3__292577_19_Forward_Primer_Seq
ccattgtaggaggacaagaatcaca

SEQ ID NO: 896 - DNA, 25 bp, Glycine max
  Clone ID: 318O13_region_A3__292577_19_Reverse_Primer_Seq
agcaacaacaacaacacagaacaca

SEQ ID NO: 897 - DNA, 27 bp, Glycine max
  Clone ID: 318O13_region_A3__445391_20_Forward_Primer_Seq
tgcatttatcattgaattagagggatt

SEQ ID NO: 898 - DNA, 25 bp, Glycine max
  Clone ID: 318O13_region_A3__445391_20_Reverse_Primer_Seq
agcaaacgcaatgcaatacagtaac

SEQ ID NO: 899 - DNA, 25 bp, Glycine max
  Clone ID: 318O13_region_A3__350540_17_Forward_Primer_Seq
gggaagagtatttcaaaccgttcaa

SEQ ID NO: 900 - DNA, 25 bp, Glycine max
  Clone ID: 318O13_region_A3__350540_17_Reverse_Primer_Seq
ttgagttaaattgtggttgcatgtt

SEQ ID NO: 901 - DNA, 26 bp, Glycine max
  Clone ID: 318O13_region_A3__453879_15_Forward_Primer_Seq
gcagcactgaacatgataagagatca

SEQ ID NO: 902 - DNA, 25 bp, Glycine max
  Clone ID: 318O13_region_A3__453879_15_Reverse_Primer_Seq
tgcaattgaagaacaagaaaggaca

SEQ ID NO: 903 - DNA, 26 bp, Glycine max
  Clone ID: 318O13_region_A3__201246_13_Forward_Primer_Seq
tgtgtggaatgcacatttagagaaga

SEQ ID NO: 904 - DNA, 25 bp, Glycine max
  Clone ID: 318O13_region_A3__201246_13_Reverse_Primer_Seq
cgcaagatgatgttgattgatatgc

SEQ ID NO: 905 - DNA, 26 bp, Glycine max
  Clone ID: 318O13_region_A3__326020_13_Forward_Primer_Seq
tgtgtggaatgcacatttagagaaga

SEQ ID NO: 906 - DNA, 25 bp, Glycine max
  Clone ID: 318O13_region_A3__326020_13_Reverse_Primer_Seq
cgcaagatgatgttgattgatatgc

SEQ ID NO: 907 - DNA, 25 bp, Glycine max
  Clone ID: 318O13_region_A3__503801_14_Forward_Primer_Seq
atttgcattcagtgtgaacattgct

SEQ ID NO: 908 - DNA, 27 bp, Glycine max
  Clone ID: 318O13_region_A3__503801_14_Reverse_Primer_Seq
tgggacttaacataatctgaggaaaga

SEQ ID NO: 909 - DNA, 25 bp, Glycine max
  Clone ID: 318O13_region_A3__302400_52_Forward_Primer_Seq
tacataaagaaccatgtgaggaagg

SEQ ID NO: 910 - DNA, 26 bp, Glycine max
  Clone ID: 318O13_region_A3__302400_52_Reverse_Primer_Seq
tgactgttgattgatagccttgttga

SEQ ID NO: 911 - DNA, 25 bp, Glycine max
  Clone ID: 318O13_region_A3__448857_15_Forward_Primer_Seq
atgaactgttgttcctgtcatgtgg

SEQ ID NO: 912 - DNA, 24 bp, Glycine max
  Clone ID: 318O13_region_A3__448857_15_Reverse_Primer_Seq
aaaccctcaaaccaccttggatac

SEQ ID NO: 913 - DNA, 25 bp, Glycine max
  Clone ID: 318O13_region_A3__48364_14_Forward_Primer_Seq
aacaagtcaccaaggcacaacttta

SEQ ID NO: 914 - DNA, 24 bp, Glycine max
  Clone ID: 318O13_region_A3__48364_14_Reverse_Primer_Seq
aagaccagagaacaagccaattcc

SEQ ID NO: 915 - DNA, 25 bp, Glycine max
  Clone ID: 318O13_region_A3__251804_48_Forward_Primer_Seq
tgttatcaatcgacgcaataatcaa

SEQ ID NO: 916 - DNA, 25 bp, Glycine max
  Clone ID: 318O13_region_A3__251804_48_Reverse_Primer_Seq
acgatgaggtgttgccatttatttc

SEQ ID NO: 917 - DNA, 26 bp, Glycine max
  Clone ID: 318O13_region_A3__382583_13_Forward_Primer_Seq
ccctctatcaagtgtatcagccctta

SEQ ID NO: 918 - DNA, 26 bp, Glycine max
  Clone ID: 318O13_region_A3__382583_13_Reverse_Primer_Seq
aggaaagtacaccatttctatcagga

SEQ ID NO: 919 - DNA, 25 bp, Glycine max
  Clone ID: 318O13_region_A3__124737_14_Forward_Primer_Seq
tccaattagttgcagaaacaagcaa

SEQ ID NO: 920 - DNA, 25 bp, Glycine max
  Clone ID: 318O13_region_A3__124737_14_Reverse_Primer_Seq
tagtcctctttggtgccaatacaca

SEQ ID NO: 921 - DNA, 25 bp, Glycine max
  Clone ID: 318O13_region_A3__124766_13_Forward_Primer_Seq
tccaattagttgcagaaacaagcaa

SEQ ID NO: 922 - DNA, 25 bp, Glycine max
  Clone ID: 318O13_region_A3__124766_13_Reverse_Primer_Seq
tagtcctctttggtgccaatacaca

SEQ ID NO: 923 - DNA, 25 bp, Glycine max
  Clone ID: 318O13_region_A3__461351_16_Forward_Primer_Seq
gaatggtgttagggttgaagcaact

SEQ ID NO: 924 - DNA, 25 bp, Glycine max
  Clone ID: 318O13_region_A3__461351_16_Reverse_Primer_Seq
atagtaatttgttgaagggcagcaa

SEQ ID NO: 925 - DNA, 26 bp, Glycine max
  Clone ID: 318O13_region_A3__64953_19__Forward_Primer_Seq
caccttgagaaacttgaaacacttga

SEQ ID NO: 926 - DNA, 25 bp, Glycine max
  Clone ID: 318O13_region_A3__64953_19_Reverse_Primer_Seq
ctctttaaagggtcactgccctcat

SEQ ID NO: 927 - DNA, 25 bp, Glycine max
  Clone ID: 318O13_region_A3__366586_13_Forward_Primer_Seq
tgtccatgcattaaagcaaacatct

SEQ ID NO: 928 - DNA, 25 bp, Glycine max
  Clone ID: 318O13_region_A3__366586_13_Reverse_Primer_Seq
gaatgcaaacatgcgttatttgtct

SEQ ID NO: 929 - DNA, 26 bp, Glycine max
  Clone ID: 318O13_region_A3__46190_15__Forward_Primer_Seq
caaacctccaatcactaaattgatcc

SEQ ID NO: 930 - DNA, 24 bp, Glycine max
  Clone ID: 318O13_region_A3__46190_15_Reverse_Primer_Seq
aagttcaggctaggccaaggtaca

SEQ ID NO: 931 - DNA, 26 bp, Glycine max
  Clone ID: 318O13_region_A3__81016_11__Forward_Primer_Seq
cctcggccaaacataactagtctaac

SEQ ID NO: 932 - DNA, 25 bp, Glycine max
  Clone ID: 318O13_region_A3__81016_11_Reverse_Primer_Seq
agccttgattccatcttgtttggta

SEQ ID NO: 933 - DNA, 25 bp, Glycine max
  Clone ID: 318O13_region_A3__134426_14_Forward_Primer_Seq
ttacactatgggtccgttcggttat

SEQ ID NO: 934 - DNA, 26 bp, Glycine max
  Clone ID: 318O13_region_A3__134426_14_Reverse_Primer_Seq
tgaaacataatggaagatgatgatgg

SEQ ID NO: 935 - DNA, 25 bp, Glycine max
  Clone ID: 318O13_region_A3__292724_14_Forward_Primer_Seq
ccattgtaggaggacaagaatcaca

SEQ ID NO: 936 - DNA, 25 bp, Glycine max
  Clone ID: 318O13_region_A3__292724_14_Reverse_Primer_Seq
taacggctcttgctttgtgaatagc

SEQ ID NO: 937 - DNA, 25 bp, Glycine max
  Clone ID: 318O13_region_A3__187096_17_Forward_Primer_Seq
gtccagccaaatgcgtaacatttat

SEQ ID NO: 938 - DNA, 26 bp, Glycine max
  Clone ID: 318O13_region_A3__187096_17_Reverse_Primer_Seq
catctagtatttgtttaacgccgaaa

SEQ ID NO: 939 - DNA, 26 bp, Glycine max
  Clone ID: 318O13_region_A3__381693_13_Forward_Primer_Seq
ttgatgttatgattcaatggtttgat

SEQ ID NO: 940 - DNA, 23 bp, Glycine max
  Clone ID: 318O13_region_A3__381693_13_Reverse_Primer_Seq
aaataccgcgtatcaacttcacc

SEQ ID NO: 941 - DNA, 25 bp, Glycine max
  Clone ID: 318O13_region_A3__361286_33_Forward_Primer_Seq
actccagttgcattctcttcgtaaa

SEQ ID NO: 942 - DNA, 26 bp, Glycine max
  Clone ID: 318O13_region_A3__361286_33_Reverse_Primer_Seq
tgaaatgtgttctttgttgcttaccc

SEQ ID NO: 943 - DNA, 25 bp, Glycine max
  Clone ID: 318O13_region_A3__482668_14_Forward_Primer_Seq
cgtttgttacttcacacgcacacat

SEQ ID NO: 944 - DNA, 26 bp, Glycine max
  Clone ID: 318O13_region_A3__482668_14_Reverse_Primer_Seq
tcagacttacgtacaagtgtgccata

SEQ ID NO: 945 - DNA, 25 bp, Glycine max
  Clone ID: 318O13_region_A3__128002_12_Forward_Primer_Seq
cttgccagggatcaaatcataaaga

SEQ ID NO: 946 - DNA, 26 bp, Glycine max
  Clone ID: 318O13_region_A3__128002_12_Reverse_Primer_Seq
tgtaagcttgcaggacaaggtaactc

SEQ ID NO: 947 - DNA, 25 bp, Glycine max
  Clone ID: 318O13_region_A3__499270_14_Forward_Primer_Seq
cactgtgtaagtgtcccttgcatct

SEQ ID NO: 948 - DNA, 25 bp, Glycine max
  Clone ID: 318O13_region_A3__499270_14_Reverse_Primer_Seq
gggatttgaatcagaagactcgttt

SEQ ID NO: 949 - DNA, 25 bp, Glycine max
  Clone ID: 318O13_region_A3__231650_12_Forward_Primer_Seq
cttcaaggctttggagaacaaacat

SEQ ID NO: 950 - DNA, 22 bp, Glycine max
  Clone ID: 318O13_region_A3__231650_12_Reverse_Primer_Seq
caccggaaaccttcctctcatc

SEQ ID NO: 951 - DNA, 25 bp, Glycine max
  Clone ID: 318O13_region_A3__199851_13_Forward_Primer_Seq
cggccatagtcatatttatgcttcc

SEQ ID NO: 952 - DNA, 25 bp, Glycine max
  Clone ID: 318O13_region_A3__199851_13_Reverse_Primer_Seq
agggttccaatcacgctattagtga

SEQ ID NO: 953 - DNA, 25 bp, Glycine max
  Clone ID: 318O13_region_A3__324629_13_Forward_Primer_Seq
cggccatagtcatatttatgcttcc

SEQ ID NO: 954 - DNA, 25 bp, Glycine max
  Clone ID: 318O13_region_A3__324629_13_Reverse_Primer_Seq
agggttccaatcacgctattagtga

SEQ ID NO: 955 - DNA, 24 bp, Glycine max
  Clone ID: 318O13_region_A3__374190_19_Forward_Primer_Seq
agccaaggtaaggcacacaaactt

SEQ ID NO: 956 - DNA, 25 bp, Glycine max
  Clone ID: 318O13_region_A3__374190_19_Reverse_Primer_Seq
tcatccaatccggtgataatagaaa

SEQ ID NO: 957 - DNA, 25 bp, Glycine max
  Clone ID: 318O13_region_A3__460603_13_Forward_Primer_Seq
cacgcaaccattcatgttacaaagt

SEQ ID NO: 958 - DNA, 25 bp, Glycine max
  Clone ID: 318O13_region_A3__460603_13_Reverse_Primer_Seq
gaggattgaatactgcccaagctaa

SEQ ID NO: 959 - DNA, 25 bp, Glycine max
  Clone ID: 318O13_region_A3__108681_14_Forward_Primer_Seq
aagagtgtgaaattggtacgacagt

SEQ ID NO: 960 - DNA, 24 bp, Glycine max
  Clone ID: 318O13_region_A3__108681_14_Reverse_Primer_Seq
gttcatcaagatgcaagcaccata

SEQ ID NO: 961 - DNA, 25 bp, Glycine max
  Clone ID: 318O13_region_A3__459791_47_Forward_Primer_Seq
tgcttatgtcagctacggtcaatct

SEQ ID NO: 962 - DNA, 25 bp, Glycine max
  Clone ID: 318O13_region_A3__459791_47_Reverse_Primer_Seq
tccgaggcgagtaggtacctctatt

SEQ ID NO: 963 - DNA, 25 bp, Glycine max
  Clone ID: 318O13_region_A3__4257_20_Forward_Primer_Seq
tcccaacgcaacagtaacgtaaata

SEQ ID NO: 964 - DNA, 26 bp, Glycine max
  Clone ID: 318O13_region_A3__4257_20__Reverse_Primer_Seq
tgaaacttgaatgtaaccactcccta

SEQ ID NO: 965 - DNA, 27 bp, Glycine max
  Clone ID: 318O13_region_A3__238810_14_Forward_Primer_Seq
caggtgttaatactcctttcatttcaa

SEQ ID NO: 966 - DNA, 25 bp, Glycine max
  Clone ID: 318O13_region_A3__238810_14_Reverse_Primer_Seq
acatcgtttctatccaatgatgacg

SEQ ID NO: 967 - DNA, 26 bp, Glycine max
  Clone ID: 318O13_region_A3__245817_14_Forward_Primer_Seq
atcataaattcattcaaacacatgct

SEQ ID NO: 968 - DNA, 25 bp, Glycine max
  Clone ID: 318O13_region_A3__245817_14_Reverse_Primer_Seq
actaccattctgcgtgtttagatca

SEQ ID NO: 969 - DNA, 26 bp, Glycine max
  Clone ID: 318O13_region_A3__245956_14_Forward_Primer_Seq
atcataaattcattcaaacacatgct

SEQ ID NO: 970 - DNA, 25 bp, Glycine max
  Clone ID: 318O13_region_A3__245956_14_Reverse_Primer_Seq
actaccattctgcgtgtttagatca

SEQ ID NO: 971 - DNA, 26 bp, Glycine max
  Clone ID: 318O13_region_A3__74148_14__Forward_Primer_Seq
tgcatgcatgtaaccagaaataataa

SEQ ID NO: 972 - DNA, 25 bp, Glycine max
  Clone ID: 318O13_region_A3__74148_14_Reverse_Primer_Seq
cacactgcaagagtgtatgaagaaa

SEQ ID NO: 973 - DNA, 26 bp, Glycine max
  Clone ID: 318O13_region_A3__74089_15__Forward_Primer_Seq
tgcatgcatgtaaccagaaataataa

SEQ ID NO: 974 - DNA, 25 bp, Glycine max
  Clone ID: 318O13_region_A3__74089_15_Reverse_Primer_Seq
cacactgcaagagtgtatgaagaaa

SEQ ID NO: 975 - DNA, 25 bp, Glycine max
  Clone ID: 318O13_region_A3__241686_12_Forward_Primer_Seq
tggatcaaatggtacttgtcaactg

SEQ ID NO: 976 - DNA, 25 bp, Glycine max
  Clone ID: 318O13_region_A3__241686_12_Reverse_Primer_Seq
ccatttgcccacattattaacatca

SEQ ID NO: 977 - DNA, 25 bp, Glycine max
  Clone ID: 318O13_region_A3__47476_12__Forward_Primer_Seq
tttgcagcaacatatctggactttc

SEQ ID NO: 978 - DNA, 24 bp, Glycine max
  Clone ID: 318O13_region_A3__47476_127_Reverse_Primer_Seq
gtgttccattatgtgcccaggttt

SEQ ID NO: 979 - DNA, 25 bp, Glycine max
  Clone ID: 318O13_region_A3__164550_12_Forward_Primer_Seq
caacataatcctaatctcccatgct

SEQ ID NO: 980 - DNA, 24 bp, Glycine max
  Clone ID: 318O13_region_A3__164550_12_Reverse_Primer_Seq
gacatatggtcctccgggaataaa

SEQ ID NO: 981 - DNA, 26 bp, Glycine max
  Clone ID: 318O13_region_A3__101255_15_Forward_Primer_Seq
gcactaattaagcctgtttcaacctg

SEQ ID NO: 982 - DNA, 27 bp, Glycine max
  Clone ID: 318O13_region_A3__101255_15_Reverse_Primer_Seq
tcatggactaattaaatgtggtcattc

SEQ ID NO: 983 - DNA, 25 bp, Glycine max
  Clone ID: 515O02_region_G2__16189_11_Forward_Primer
ttccacaaatccaaattccaaattc

SEQ ID NO: 984 - DNA, 25 bp, Glycine max
  Clone ID: 515O02_region_G2__16189_11_Reverse_Primer
tgagattccataggaaatcaaagca

SEQ ID NO: 985 - DNA, 26 bp, Glycine max
  Clone ID: 515O02_region_G2__71925_13_Forward_Primer
tccgactttgtggctatatatgtgtg

SEQ ID NO: 986 - DNA, 25 bp, Glycine max
  Clone ID: 515O02_region_G2__71925_13_Reverse_Primer
agttgtgcccgatgtacattacaaa

SEQ ID NO: 987 - DNA, 25 bp, Glycine max
  Clone ID: 515O02_region_G2__4707_12_Forward_Primer
caagatcaagcacccttgtttctct

SEQ ID NO: 988 - DNA, 27 bp, Glycine max
  Clone ID: 515O02_region_G2__4707_12Reverse_Primer
tttccattacagacagtagcgtgtaaa

SEQ ID NO: 989 - DNA, 25 bp, Glycine max
  Clone ID: 515O02_region_G2__118904_18_Forward_Primer
tagctgcatcacctctcagtttctg

SEQ ID NO: 990 - DNA, 26 bp, Glycine max
  Clone ID: 515O02_region_G2__118904_18_Reverse_Primer
ttgtccttaaatgtagccctgatttc

SEQ ID NO: 991 - DNA, 26 bp, Glycine max
  Clone ID: 515O02_region_G2__13655_17_Forward_Primer
gagtcaatttccttaaacccatcaca

SEQ ID NO: 992 - DNA, 26 bp, Glycine max
  Clone ID: 515O02_region_G2__13655_17_Reverse_Primer
aagctcctgtggacttgatactcaga

SEQ ID NO: 993 - DNA, 25 bp, Glycine max
  Clone ID: 515O02_region_G2__53900_13_Forward_Primer
atttcttcacatcgtcatcccaaac

SEQ ID NO: 994 - DNA, 25 bp, Glycine max
  Clone ID: 515O02_region_G2__53900_13_Reverse_Primer
atgtgcttggtggaatgtaaggatt

SEQ ID NO: 995 - DNA, 25 bp, Glycine max
  Clone ID: 515O02_region_G2__8079_14_Forward_Primer
gtgagagttaagctgggaacctttg

SEQ ID NO: 996 - DNA, 25 bp, Glycine max
  Clone ID: 515O02_region_G2__8079_14_Reverse_Primer
gatctctgtctctcttccctcttgc

SEQ ID NO: 997 - DNA, 25 bp, Glycine max
  Clone ID: 515O02_region_G2__9969_28_Forward_Primer
tcaccagagacgcattatcagattc

SEQ ID NO: 998 - DNA, 25 bp, Glycine max
  Clone ID: 515O02_region_G2__9969_28_Reverse_Primer
cgctaccagctactgtttccttctc

SEQ ID NO: 999 - DNA, 27 bp, Glycine max
  Clone ID: 515O02_region_G2__72308_77_Forward_Primer
tttcttaaacagatcactggtatgcaa

SEQ ID NO: 1000 - DNA, 25 bp, Glycine max
  Clone ID: 515O02_region_G2__72308_77_Reverse_Primer
cgctaccagctactgtttccttctc

SEQ ID NO: 1001 - DNA, 26 bp, Glycine max
  Clone ID: 515O02_region_G2__99475_19_Forward_Primer
tgcacaatgagatttgaagtcatgta

SEQ ID NO: 1002 - DNA, 25 bp, Glycine max
  Clone ID: 515O02_region_G2__99475_19_Reverse_Primer
ttgagtcaggaatcttcgattaccc

SEQ ID NO: 1003 - DNA, 24 bp, Glycine max
  Clone ID: 515O02_region_G2__118615_18_Forward_Primer
atcatggatctgattccacctgaa

SEQ ID NO: 1004 - DNA, 25 bp, Glycine max
  Clone ID: 515O02_region_G2__118615_18_Reverse_Primer
tgattgtatgtatgggcgctaagtt

SEQ ID NO: 1005 - DNA, 26 bp, Glycine max
  Clone ID: 515O02_region_G2__119001_46_Forward_Primer
tgaaatcagggctacatttaaggaca

SEQ ID NO: 1006 - DNA, 25 bp, Glycine max
  Clone ID: 515O02_region_G2__119001_46_Reverse_Primer
aggcatttggtcaacttgattatgc

SEQ ID NO: 1007 - DNA, 26 bp, Glycine max
  Clone ID: 515O02_region_G2__118958_43_Forward_Primer
tgaaatcagggctacatttaaggaca

SEQ ID NO: 1008 - DNA, 25 bp, Glycine max
  Clone ID: 515O02_region_G2__118958_43_Reverse_Primer
aggcatttggtcaacttgattatgc

SEQ ID NO: 1009 - DNA, 25 bp, Glycine max
  Clone ID: 515O02_region_G2__17197_13_Forward_Primer
cggagtcggagtagtcgagtagaca

SEQ ID NO: 1010 - DNA, 25 bp, Glycine max
  Clone ID: 515O02_region_G2__17197_13_Reverse_Primer
cataataccgagtccgatgaaacct

SEQ ID NO: 1011 - DNA, 25 bp, Glycine max
  Clone ID: 515O02_region_G2__105163_29_Forward_Primer
ttccaattccttagcctatcaaaca

SEQ ID NO: 1012 - DNA, 26 bp, Glycine max
  Clone ID: 515O02_region_G2__105163_29_Reverse_Primer
aacatttgtacctatgcattcccatc

SEQ ID NO: 1013 - DNA, 25 bp, Glycine max
  Clone ID: 515O02_region_G2__111335_13_Forward_Primer
atacttacaatccgtcaggcagctc

SEQ ID NO: 1014 - DNA, 25 bp, Glycine max
  Clone ID: 515O02_region_G2__111335_13_Reverse_Primer
tcatgttatgagtttgcgctcttgt

SEQ ID NO: 1015 - DNA, 25 bp, Glycine max
  Clone ID: 515O02_region_G2__106396_13_Forward_Primer
ctgtcaagggaggaaattggtacag

SEQ ID NO: 1016 - DNA, 25 bp, Glycine max
  Clone ID: 515O02_region_G2__106396_13_Reverse_Primer
aacaactgccagaagaaagtaccag

SEQ ID NO: 1017 - DNA, 25 bp, Glycine max
  Clone ID: 515O02_region_G2__59229_17_Forward_Primer
gcttgtcaggagagaaatgttgctt

SEQ ID NO: 1018 - DNA, 25 bp, Glycine max
  Clone ID: 515O02_region_G2__59229_17_Reverse_Primer
aattcagcaaatgaaacatgggagt

SEQ ID NO: 1019 - DNA, 25 bp, Glycine max
  Clone ID: 515O02_region_G2__73795_20_Forward_Primer
tggcaacacttaatttgcacagata

SEQ ID NO: 1020 - DNA, 26 bp, Glycine max
  Clone ID: 515O02_region_G2__73795_20_Reverse_Primer
gggaagaataacaaattaaacccttt

SEQ ID NO: 1021 - DNA, 26 bp, Glycine max
  Clone ID: 515O02_region_G2__85664_20_Forward_Primer
tgtcaatcaataaccattgatctcct

SEQ ID NO: 1022 - DNA, 25 bp, Glycine max
  Clone ID: 515O02_region_G2__85664_20_Reverse_Primer
ttggtttctatttacgggtaccaaa

SEQ ID NO: 1023 - DNA, 25 bp, Glycine max
  Clone ID: 515O02_region_G2__36921_17_Forward_Primer
ccgagacccacttggtattacttca

SEQ ID NO: 1024 - DNA, 25 bp, Glycine max
  Clone ID: 515O02_region_G2__36921_17_Reverse_Primer
aggagtgagaaattgcttctccaaa

SEQ ID NO: 1025 - DNA, 24 bp, Glycine max
  Clone ID: 515O02_region_G2__124150_19_Forward_Primer
aagtggttgcacacagcatctagg

SEQ ID NO: 1026 - DNA, 25 bp, Glycine max
  Clone ID: 515O02_region_G2__124150_19_Reverse_Primer
tcactgaacactgatttctgccatt

SEQ ID NO: 1027 - DNA, 26 bp, Glycine max
  Clone ID: 515O02_region_G2__5089_14_Forward_Primer
tcatacctgaaatatgggtgtcttca

SEQ ID NO: 1028 - DNA, 25 bp, Glycine max
  Clone ID: 515O02_region_G2__5089_14_Reverse_Primer
cataacaagacaggttgaggcaaca

SEQ ID NO: 1029 - DNA, 24 bp, Glycine max
  Clone ID: 515O02_region_G2__58221_15_Forward_Primer
catttcaaagggagagccatcatc

SEQ ID NO: 1030 - DNA, 25 bp, Glycine max
  Clone ID: 515O02_region_G2__58221_15_Reverse_Primer
catggaaatggagaaagcaaagaaa

SEQ ID NO: 1031 - DNA, 25 bp, Glycine max
  Clone ID: 515O02_region_G2__96139_14_Forward_Primer
ccctcaagccaatgatagtaactcc

SEQ ID NO: 1032 - DNA, 25 bp, Glycine max
  Clone ID: 515O02_region_G2__96139_14_Reverse_Primer
aactcgtcctatgctcaaccttacg

SEQ ID NO: 1033 - DNA, 25 bp, Glycine max
  Clone ID: 515O02_region_G2__70595_13_Forward_Primer
ttgggaactgtacacatgccttaat

SEQ ID NO: 1034 - DNA, 27 bp, Glycine max
  Clone ID: 515O02_region_G2__70595_13_Reverse_Primer
tgtttgtggtatttcatttggaattat

SEQ ID NO: 1035 - DNA, 26 bp, Glycine max
  Clone ID: 515O02_region_G2__4340_15_Forward_Primer
aaatatgggtacatcatccgatacaa

SEQ ID NO: 1036 - DNA, 24 bp, Glycine max
  Clone ID: 515O02_region_G2__4340_15_Reverse_Primer
tttggatatgagaaggagggaagg

SEQ ID NO: 1037 - DNA, 25 bp, Glycine max
  Clone ID: 515O02_region_G2__90417_11_Forward_Primer
aaactgcaaacacaaattgcctaaa

SEQ ID NO: 1038 - DNA, 25 bp, Glycine max
  Clone ID: 515O02_region_G2__90417_11_Reverse_Primer
cctggtagcctgtacttgacttggt

SEQ ID NO: 1039 - DNA, 25 bp, Glycine max
  Clone ID: 515O02_region_G2__49711_17_Forward_Primer
caaagagaggcagaggaggtgatta

SEQ ID NO: 1040 - DNA, 25 bp, Glycine max
  Clone ID: 515O02_region_G2__49711_17_Reverse_Primer
tggttgtagctgcttgtcatttgat

SEQ ID NO: 1041 - DNA, 25 bp, Glycine max
  Clone ID: 515O02_region_G2__63053_13_Forward_Primer
tgtgcataactcgatctcttgatga

SEQ ID NO: 1042 - DNA, 26 bp, Glycine max
  Clone ID: 515O02_region_G2__63053_13_Reverse_Primer
tcttgctgcaatctttactaacagca

SEQ ID NO: 1043 - DNA, 25 bp, Glycine max
  Clone ID: 515O02_region_G2__63076_14_Forward_Primer
tgtgcataactcgatctcttgatga

SEQ ID NO: 1044 - DNA, 26 bp, Glycine max
  Clone ID: 515O02_region_G2__63076_14_Reverse_Primer
tcttgctgcaatctttactaacagca

SEQ ID NO: 1045 - DNA, 25 bp, Glycine max
  Clone ID: 515O02_region_G2__44442_12_Forward_Primer
aacgcgtctttctttcttcttcaac

SEQ ID NO: 1046 - DNA, 25 bp, Glycine max
  Clone ID: 515O02_region_G2__44442_12_Reverse_Primer
gcaacatggctatatgaaacacctc

SEQ ID NO: 1047 - DNA, 25 bp, Glycine max
  Clone ID: 515O02_region_G2__44422_19_Forward_Primer
aacgcgtctttctttcttcttcaac

SEQ ID NO: 1048 - DNA, 25 bp, Glycine max
  Clone ID: 515O02_region_G2__44422_19_Reverse_Primer
gcaacatggctatatgaaacacctc

SEQ ID NO: 1049 - DNA, 26 bp, Glycine max
  Clone ID: 515O02_region_G2__44158_19_Forward_Primer
tttcattacgtgcgtttgtacaacta

SEQ ID NO: 1050 - DNA, 26 bp, Glycine max
  Clone ID: 515O02_region_G2__44158_19_Reverse_Primer
cagggtggatgatacgaatacgatac

SEQ ID NO: 1051 - DNA, 26 bp, Glycine max
  Clone ID: 515O02_region_G2__44141_17_Forward_Primer
tttcattacgtgcgtttgtacaacta

SEQ ID NO: 1052 - DNA, 26 bp, Glycine max
  Clone ID: 515O02_region_G2__44141_17_Reverse_Primer
cagggtggatgatacgaatacgatac

SEQ ID NO: 1053 - DNA, 27 bp, Glycine max
  Clone ID: 515O02_region_G2__90762_17_Forward_Primer
ccagagatatgattcaatacaaaggaa

SEQ ID NO: 1054 - DNA, 25 bp, Glycine max
  Clone ID: 515O02_region_G2__90762_17_Reverse_Primer
attaccctgtggtaacggattcaag

SEQ ID NO: 1055 - DNA, 25 bp, Glycine max
  Clone ID: 515O02_region_G2__106241_14_Forward_Primer
tagatagctagccatgttggcatga

SEQ ID NO: 1056 - DNA, 25 bp, Glycine max
  Clone ID: 515O02_region_G2__106241_14_Reverse_Primer
tgtaccaatttcctcccttgacagt

SEQ ID NO: 1057 - DNA, 26 bp, Glycine max
  Clone ID: 515O02_region_G2__109676_12_Forward_Primer
tcattgtctttgaggactttctcatt

SEQ ID NO: 1058 - DNA, 26 bp, Glycine max
  Clone ID: 515O02_region_G2__109676_12_Reverse_Primer
tcactgacactgagtgatagccattt

SEQ ID NO: 1059 - DNA, 25 bp, Glycine max
  Clone ID: 515O02_region_G2__86242_14_Forward_Primer
ccacaactccgatttatcccataac

SEQ ID NO: 1060 - DNA, 26 bp, Glycine max
  Clone ID: 515O02_region_G2__86242_14_Reverse_Primer
gcacaaagaagaaatttggagtttca

SEQ ID NO: 1061 - DNA, 25 bp, Glycine max
  Clone ID: 515O02_region_G2__83109_12_Forward_Primer
tcaccctttaggagatcctagacac

SEQ ID NO: 1062 - DNA, 25 bp, Glycine max
  Clone ID: 515O02_region_G2__83109_12_Reverse_Primer
ctcttgccaatgattgaaggaagtc

SEQ ID NO: 1063 - DNA, 25 bp, Glycine max
  Clone ID: 515O02_region_G2__10461_15_Forward_Primer
ggctgtgtgtgagtgagagtgagag

SEQ ID NO: 1064 - DNA, 25 bp, Glycine max
  Clone ID: 515O02_region_G2__10461_15_Reverse_Primer
tgcacccttattcctcctaatcatc

SEQ ID NO: 1065 - DNA, 26 bp, Glycine max
  Clone ID: 515O02_region_G2__67608_15_Forward_Primer
ggtggttagatccaatttcatgttga

SEQ ID NO: 1066 - DNA, 25 bp, Glycine max
  Clone ID: 515O02_region_G2__67608_15_Reverse_Primer
tcctgtacagcacgtatccgtattt

SEQ ID NO: 1067 - DNA, 26 bp, Glycine max
  Clone ID: 515O02_region_G2__63275_46_Forward_Primer
tgctgttagtaaagattgcagcaaga

SEQ ID NO: 1068 - DNA, 25 bp, Glycine max
  Clone ID: 515O02_region_G2__63275_46_Reverse_Primer
tatactccgctcctcaattccttca

SEQ ID NO: 1069 - DNA, 26 bp, Glycine max
  Clone ID: 515O02_region_G2__62405_14_Forward_Primer
tgcatagagagaaatagacgaggaaa

SEQ ID NO: 1070 - DNA, 25 bp, Glycine max
  Clone ID: 515O02_region_G2__62405_14_Reverse_Primer
atctcttccaaacggtccataagtt

SEQ ID NO: 1071 - DNA, 25 bp, Glycine max
  Clone ID: 515O02_region_G2__33563_12_Forward_Primer
ccttaggtgctcatacatccaaaca

SEQ ID NO: 1072 - DNA, 25 bp, Glycine max
  Clone ID: 515O02_region_G2__33563_12_Reverse_Primer
tgattcatatacaacgcaagaaacg

SEQ ID NO: 1073 - DNA, 25 bp, Glycine max
  Clone ID: 515O02_region_G2__33146_14_Forward_Primer
cgaaccctaaacatttcaaaccaaa

SEQ ID NO: 1074 - DNA, 25 bp, Glycine max
  Clone ID: 515O02_region_G2__33146_14_Reverse_Primer
tttcagaagaaaggttggaaacaca

SEQ ID NO: 1075 - DNA, 25 bp, Glycine max
  Clone ID: 515O02_region_G2__102179_29_Forward_Primer
aatctcgattgtcttcttgcgaaat

SEQ ID NO: 1076 - DNA, 26 bp, Glycine max
  Clone ID: 515O02_region_G2__102179_29_Reverse_Primer
tccaacaagtcaacaatcaagcaata

SEQ ID NO: 1077 - DNA, 25 bp, Glycine max
  Clone ID: 515O02_region_G2__2646_15_Forward_Primer
ccaaaggcttagtttcatttgcatt

SEQ ID NO: 1078 - DNA, 26 bp, Glycine max
  Clone ID: 515O02_region_G2__2646_15_Reverse_Primer
gaaataaacaaatccaacttctctcg

SEQ ID NO: 1079 - DNA, 25 bp, Glycine max
  Clone ID: 515O02_region_G2__76652_24_Forward_Primer
actaactcttgcgtgctccttgttt

SEQ ID NO: 1080 - DNA, 24 bp, Glycine max
  Clone ID: 515O02_region_G2__76652_24_Reverse_Primer
ccctgggacatatactggatcaaa

SEQ ID NO: 1081 - DNA, 26 bp, Glycine max
  Clone ID: 515O02_region_G2__66280_14_Forward_Primer
gtgttagattgattaaagttcgctga

SEQ ID NO: 1082 - DNA, 26 bp, Glycine max
  Clone ID: 515O02_region_G2__66280_14_Reverse_Primer
agatttagcccatgattaaagtgaaa

SEQ ID NO: 1083 - DNA, 27 bp, Glycine max
  Clone ID: 515O02_region_G2__54768_13_Forward_Primer
aaattaccaatcatgtatggagtgaga

SEQ ID NO: 1084 - DNA, 25 bp, Glycine max
  Clone ID: 515O02_region_G2__54768_13_Reverse_Primer
caggcacaatattgcaccataactt

SEQ ID NO: 1085 - DNA, 25 bp, Glycine max
  Clone ID: 515O02_region_G2__62580_14_Forward_Primer
aacttatggaccgtttggaagagat

SEQ ID NO: 1086 - DNA, 25 bp, Glycine max
  Clone ID: 515O02_region_G2__62580_14_Reverse_Primer
aaaggaggagcaaagagtgaagatt

SEQ ID NO: 1087 - DNA, 25 bp, Glycine max
  Clone ID: 515O02_region_G2__34598_55_Forward_Primer
aaagtctggtctgaactgacccatt

SEQ ID NO: 1088 - DNA, 27 bp, Glycine max
  Clone ID: 515O02_region_G2__34598_55_Reverse_Primer
ggaatggaagttatggagcagtaatgt

SEQ ID NO: 1089 - DNA, 27 bp, Glycine max
  Clone ID: 515O02_region_G2__77680_13_Forward_Primer
tgacatgaactatctcaaacaatgcaa

SEQ ID NO: 1090 - DNA, 26 bp, Glycine max
  Clone ID: 515O02_region_G2__77680_13_Reverse_Primer
aacaactgttatttacacctcccaga

SEQ ID NO: 1091 - DNA, 27 bp, Glycine max
  Clone ID: 515O02_region_G2__77693_12_Forward_Primer
tgacatgaactatctcaaacaatgcaa

SEQ ID NO: 1092 - DNA, 26 bp, Glycine max
  Clone ID: 515O02_region_G2__77693_12_Reverse_Primer
aacaactgttatttacacctcccaga

SEQ ID NO: 1093 - DNA, 26 bp, Glycine max
  Clone ID: 515O02_region_G2__97392_14_Forward_Primer
tttgatgtagttgatttatgcactcg

SEQ ID NO: 1094 - DNA, 25 bp, Glycine max
  Clone ID: 515O02_region_G2__97392_14_Reverse_Primer
gtgacatcaggcaacctagtttagt

SEQ ID NO: 1095 - DNA, 26 bp, Glycine max
  Clone ID: 515O02_region_G2__97359_15_Forward_Primer
tttgatgtagttgatttatgcactcg

SEQ ID NO: 1096 - DNA, 25 bp, Glycine max
  Clone ID: 515O02_region_G2__97359_15_Reverse_Primer
gtgacatcaggcaacctagtttagt

SEQ ID NO: 1097 - protein, 877 aa, Glycine max
  Clone ID: 240O17_region_G3
MDACGMSSSNSKHVVDQKRSTMNMMITTILLRFWDRYDMNCDYTTNSYEPGTQLAPSSPRDTSVKLGDASSLVVLPSCVRPVLCEDEGWDGVVVTASNLLALEAFKQELVDPEGFLRSWNDSGYGACSGGWVGIKCAKGQVIVIQLPWKGLRGRITDKIGQLQGLRKLSLHDNQIGGSIPSTLGLLPNLRGVQLFNNRLTGSIPLSLGFCPLLQSLDLSNNLLTGAIPYSLANSTKLYWLNLSFNSFSGPLPASLTHSFSLTFLSLQNNNLSGSLPNSWGGNSKNGFFRLQNLILDHNFFTGDVPASLGSLRELNEISLSHNKFSGAIPNEIGTLSRLKTLDISNNALNGNLPATLSNLSSLTLLNAENNLLDNQIPQSLGRLRNLSVLILSRNQFSGHIPSSIANISSLRQLDLSLNNFSGEIPVSFDSQRSLNLFNVSYNSLSGSVPPLLAKKFNSSSFVGNIQLCGYSPSTPCLSQAPSQGVIAPPPEVSKHHHHRKLSTKDIILIVAGVLLVVLIILCCVLLFCLIRKRSTSKAGNGQATEGRAATMRTEKGVPPVAGGDVEAGGEAGGKLVHFDGPMAFTADDLLCATAEIMGKSTYGTVYKAILEDGSQVAVKRLREKITKGHREFESEVSVLGKIRHPNVLALRAYYLGPKGEKLLVFDYMSKGSLASFLHGGGTETFIDWPTRMKIAQDLARGLFCLHSQENIIHGNLTSSNVLLDENTNAKIADFGLSRLMSTAANSNVIATAGALGYRAPELSKLKKANTKTDIYSLGVILLELLTRKSPGVSMNGLDLPQWVASVVKEEWTNEVFDADLMRDASTVGDELLNTLKLALHCVDPSPSARPEVHQVLQQLEEIRPERSVTASPGDDIV

SEQ ID NO: 1098 - protein, 854 aa, Glycine max
  Clone ID: 240O17_region_G3
MVVAVEKTNLTSQSQCFNRVSDKKKERCKTHMNNVNPCCFLFLLCVWSLVVLPSCVRPVLCEDEGWDGVVVTASNLLALEAFKQELVDPEGFLRSWNDSGYGACSGGWVGIKCAKGQVIVIQLPWKGLRGRITDKIGQLQGLRKLSLHDNQIGGSIPSTLGLLPNLRGVQLFNNRLTGSIPLSLGFCPLLQSLDLSNNLLTGAIPYSLANSTKLYWLNLSFNSFSGPLPASLTHSFSLTFLSLQNNNLSGSLPNSWGGNSKNGFFRLQNLILDHNFFTGDVPASLGSLRELNEISLSHNKFSGAIPNEIGTLSRLKTLDISNNALNGNLPATLSNLSSLTLLNAENNLLDNQIPQSLGRLRNLSVLILSRNQFSGHIPSSIANISSLRQLDLSLNNFSGEIPVSFDSQRSLNLFNVSYNSLSGSVPPLLAKKFNSSSFVGNIQLCGYSPSTPCLSQAPSQGVIAPPPEVSKHHHHRKLSTKDIILIVAGVLLVVLIILCCVLLFCLIRKRSTSKAGNGQATEGRAATMRTEKGVPPVAGGDVEAGGEAGGKLVHFDGPMAFTADDLLCATAEIMGKSTYGTVYKAILEDGSQVAVKRLREKITKGHREFESEVSVLGKIRHPNVLALRAYYLGPKGEKLLVFDYMSKGSLASFLHGGGTETFIDWPTRMKIAQDLARGLFCLHSQENIIHGNLTSSNVLLDENTNAKIADFGLSRLMSTAANSNVIATAGALGYRAPELSKLKKANTKTDIYSLGVILLELLTRKSPGVSMNGLDLPQWVASVVKEEWTNEVFDADLMRDASTVGDELLNTLKLALHCVDPSPSARPEVHQVLQQLEEIRPERSVTASPGDDIV

SEQ ID NO: 1099 - protein, 894 aa, Glycine max
  Clone ID: 318O13_region_A3
MSNFLKSLTPPPSGWSETTPFCQWKGIQCDSSSHVTSISLASHSLTGTLPSDLNSLSQLRTLSLQDNSLTGTLPSLSNLSFLQTVYLNRNNFSSVSPTAFASLTSLQTLSLGSNPALQPWSFPTDLTSSSNLIDLDLATVSLTGPLPDIFDKFPSLQHLRLSYNNLTGNLPSSFSAANNLETLWLNNQAAGLSGTLLVLSNMSALNQSWLNKNQFTGSIPDLSQCTALSDLQLRDNQLTGVVPASLTSLPSLKKVSLDNNELQGPVPVFGKGVNVTLDGINSFCLDTPGNCDPRVMVLLQIAEAFGYPIRLAESWKGNDPCDGWNYVVCAAGKIITVNFEKQGLQGTISPAFANLTDLRTLFLNGNNLIGSIPDSLITLPQLQTLDVSDNNLSGLVPKFPPKVKLVTAGNALLGKPLSPGGGPSGTTPSGSSTGGSGGESSKGNSSVSPGWIAGIVVIVLFFIAVVLFVSWKCFVNKLQGKFSRVKGHENGKGGFKLDAVHVSNGYGGVPVELQSQSSGDRSDLHALDGPTFSIQVLRQVTNNFSEENILGRGGFGVVYKGVLHDGTKIAVKRMESVAMGNKGQKEFEAEIALLSKVRHRHLVALLGYCINGNERLLVYEYMPQGTLTQHLFEWQEHGYAPLTWKQRVVIALDVARGVEYLHSLAQQSFIHRDLKPSNILLGDDMRAKVADFGLVKNAPDGKYSVETRLAGTFGYLAPEYAATGRVTTKVDVYAFGVVLMELITGRKALDDTVPDERSHLVTWFRRVLINKENIPKAIDQILNPDEETMGSIYTVAELAGHCTAREPYQRPDMGHAVNVLVPLVEQWKPTSHDEEEEDGSGGDLHMSLPQALRRWQANEGTSSIFNDISISQTQSSISSKPAGFADSFDSMDCR

SEQ ID NO: 1100 - protein, 877 aa, Glycine max; identical to SEQ ID NO: 1097
  Clone ID: rhg1_A3244_amplicon

SEQ ID NO: 1101 - protein, 854 aa, Glycine max; identical to SEQ ID NO: 1098
  Clone ID: rhg1_A3244_amplicon

SEQ ID NO: 1102 - protein, 877 aa, Glycine max
  Clone ID: rhg1_peking_amplicon
MDACGMSSSNSKHVVDQKRSTMNMMITTILLRFWDRYDMNCDYTTNSYEPGTQLAPSSPRDTSVKLGDASSLVVLPSCVRPVLCEDEGWDGVVVTASNLLALEAFKQELADPEGFLRSWNDSGYGACSGGWVGIKCAQGQVIVIQLPWKGLRGRITDKIGQLQGLRKLSLHDNQIGGSIPSTLGLLPNLRGVQLFNNRLTGSIPLSLGFCPLLQSLDLSNNLLTGAIPYSLANSTKLYWLNLSFNSFSGPLPASLTHSFSLTFLSLQNNNLSGSLPNSWGGNSKNGFFRLQNLILDHNFFTGDVPASLGSLRELNEISLSHNKFSGAIPNEIGTLSRLKTLDISNNALNGNLPATLSNLSSLTLLNAENNLLDNQIPQSLGRLRNLSVLILSRNQFSGHIPSSIANISSLRQLDLSLNNFSGEIPVSFDSQRSLNLFNVSYNSLSGSVPPLLAKKFNSSSFVGNIQLCGYSPSTPCLSQAPSQGVIAPPPEVSKHHHHRKLSTKDIILIVAGVLLVVLIILCCVLLFCLIRKRSTSKAGNGQATEGRAATMRTEKGVPPVAGGDVEAGGEAGGKLVHFDGPMAFTADDLLCATAEIMGKSTYGTVYKAILEDGSQVAVKRLREKITKGHREFESEVSVLGKIRHPNVLALRAYYLGPKGEKLLVFDYMSKGSLASFLHGGGTETFIDWPTRMKIAQDLARGLFCLHSQENIIHGNLTSSNVLLDENTNAKIADFGLSRLMSTAANSNVIATAGALGYRAPELSKLKKANTKTDIYSLGVILLELLTRKSPGVSMNGLDLPQWVASVVKEEWTNEVFDADLMRDASTVGDELLNTLKLALHCVDPSPSARPEVHQVLQQLEEIRPERSVTASPGDDIV

SEQ ID NO: 1103 - protein, 854 aa, Glycine max
  Clone ID: rhg1_peking_amplicon
MVVAVEKTNLTSQSQCFNRVSDKKKERCKTHMNNVNPCCFLFLLCVWSLVVLPSCVRPVLCEDEGWDGVVVTASNLLALEAFKQELADPEGFLRSWNDSGYGACSGGWVGIKCAQGQVIVIQLPWKGLRGRITDKIGQLQGLRKLSLHDNQIGGSIPSTLGLLPNLRGVQLFNNRLTGSIPLSLGFCPLLQSLDLSNNLLTGAIPYSLANSTKLYWLNLSFNSFSGPLPASLTHSFSLTFLSLQNNNLSGSLPNSWGGNSKNGFFRLQNLILDHNFFTGDVPASLGSLRELNEISLSHNKFSGAIPNEIGTLSRLKTLDISNNALNGNLPATLSNLSSLTLLNAENNLLDNQIPQSLGRLRNLSVLILSRNQFSGHIPSSIANISSLRQLDLSLNNFSGEIPVSFDSQRSLNLFNVSYNSLSGSVPPLLAKKFNSSSFVGNIQLCGYSPSTPCLSQAPSQGVIAPPPEVSKHHHHRKLSTKDIILIVAGVLLVVLIILCCVLLFCLIRKRSTSKAGNGQATEGRAATMRTEKGVPPVAGGDVEAGGEAGGKLVHFDGPMAFTADDLLCATAEIMGKSTYGTVYKAILEDGSQVAVKRLREKITKGHREFESEVSVLGKIRHPNVLALRAYYLGPKGEKLLVFDYMSKGSLASFLHGGGTETFIDWPTRMKIAQDLARGLFCLHSQENIIHGNLTSSNVLLDENTNAKIADFGLSRLMSTAANSNVIATAGALGYRAPELSKLKKANTKTDIYSLGVILLELLTRKSPGVSMNGLDLPQWVASVVKEEWTNEVFDADLMRDASTVGDELLNTLKLALHCVDPSPSARPEVHQVLQQLEEIRPERSVTASPGDDIV

SEQ ID NO: 1104 - protein, 877 aa, Glycine max
  Clone ID: rhg1_toyosuzu_amplicon
MDACGMSSSNSKHVVDQKRSTMNMMITTILLRFWDRYDMNCDYTTNSYEPGTQLAPSSPRDTSVKLGDASSLVVLPSCVRPVLCEDEGWDGVVVTASNLLALEAFKQELVDPEGFLRSWNDSGYGACSGGWVGIKCAQGQVIVIQLPWKGLRGRITDKIGQLQGLRKLSLHDNQIGGSIPSTLGLLPNLRGVQLFNNRLTGSIPLSLGFCPLLQSLDLSNNLLTGAIPYSLANSTKLYWLNLSFNSFSGPLPASLTHSFSLTFLSLQNNNLSGSLPNSWGGNSKNGFFRLQNLILDHNFFTGDVPASLGSLRELNEISLSHNKFSGAIPNEIGTLSRLKTLDISNNALNGNLPATLSNLSSLTLLNAENNLLDNQIPQSLGRLRNLSVLILSRNQFSGHIPSSIANISSLRQLDLSLNNFSGEIPVSFDSQRSLNLFNVSYNSLSGSVPPLLAKKFNSSSFVGNIQLCGYSPSTPCLSQAPSQGVIAPPPEVSKHHHHRKLSTKDIILIVAGVLLVVLIILCCVLLFCLIRKRSTSKAGNGQATEGRAATMRTEKGVPPVAGGDVEAGGEAGGKLVHFDGPMAFTADDLLCATAEIMGKSTYGTVYKAILEDGSQVAVKRLREKITKGHREFESEVSVLGKIRHPNVLALRAYYLGPKGEKLLVFDYMSKGSLASFLHGGGTETFIDWPTRMKIAQDLARGLFCLHSQENIIHGNLTSSNVLLDENTNAKIADFGLSRLMSTAANSNVIATAGALGYRAPELSKLKKANTKTDIYSLGVILLELLTRKSPGVSMNGLDLPQWVASVVKEEWTNEVFDADLMRDASTVGDELLNTLKLALHCVDPSPSARPEVHQVLQQLEEIRPERSVTASPGDDIV

SEQ ID NO: 1105 - protein, 854 aa, Glycine max
  Clone ID: rhg1_toyosuzu_amplicon
MVVAVEKTNLTSQSQCFNRVSDKKKERCKTHMNNVNPCCFLFLLCVWSLVVLPSCVRPVLCEDEGWDGVVVTASNLLALEAFKQELVDPEGFLRSWNDSGYGACSGGWVGIKCAQGQVIVIQLPWKGLRGRITDKIGQLQGLRKLSLHDNQIGGSIPSTLGLLPNLRGVQLFNNRLTGSIPLSLGFCPLLQSLDLSNNLLTGAIPYSLANSTKLYWLNLSFNSFSGPLPASLTHSFSLTFLSLQNNNLSGSLPNSWGGNSKNGFFRLQNLILDHNFFTGDVPASLGSLRELNEISLSHNKFSGAIPNEIGTLSRLKTLDISNNALNGNLPATLSNLSSLTLLNAENNLLDNQIPQSLGRLRNLSVLILSRNQFSGHIPSSIANISSLRQLDLSLNNFSGEIPVSFDSQRSLNLFNVSYNSLSGSVPPLLAKKFNSSSFVGNIQLCGYSPSTPCLSQAPSQGVIAPPPEVSKHHHHRKLSTKDIILIVAGVLLVVLIILCCVLLFCLIRKRSTSKAGNGQATEGRAATMRTEKGVPPVAGGDVEAGGEAGGKLVHFDGPMAFTADDLLCATAEIMGKSTYGTVYKAILEDGSQVAVKRLREKITKGHREFESEVSVLGKIRHPNVLALRAYYLGPKGEKLLVFDYMSKGSLASFLHGGGTETFIDWPTRMKIAQDLARGLFCLHSQENIIHGNLTSSNVLLDENTNAKIADFGLSRLMSTAANSNVIATAGALGYRAPELSKLKKANTKTDIYSLGVILLELLTRKSPGVSMNGLDLPQWVASVVKEEWTNEVFDADLMRDASTVGDELLNTLKLALHCVDPSPSARPEVHQVLQQLEEIRPERSVTASPGDDIV

SEQ ID NO: 1106 - protein, 877 aa, Glycine max; identical to SEQ ID NO: 1097
  Clone ID: rhg1_will_amplicon

SEQ ID NO: 1107 - protein, 854 aa, Glycine max; identical to SEQ ID NO: 1098
  Clone ID: rhg1_will_amplicon

SEQ ID NO: 1108 - protein, 877 aa, Glycine max
  Clone ID: rhg1_a2704_amplicon
MDACGMSSSNSKHVVDQKRSTMNMMITTILLRFWDRYDMNCDYTTNSYEPGTQLAPSSPRDTSVKLGDASSLVVLPSCVRPVLCEDEGWDGVVVTASNLLALEAFKQELVDPEGFLRSWNDSGYGACSGGWVGIKCAKGQVIVIQLPWKGLRGRITDKIGQLQGLRKLSLHDNQIGGSIPSTLGLLPNLRGVQLFNNRLTGSIPLSLGFCPLLQSLDLSNNLLTGAIPYSLANSTKLYWLNLSFNSFSGPLPASLTHSFSLTFLSLQNNNLSGSLPNSWGGNSKNGFFRLQNLILDHNFFTGDVPASLGSLRELNEISLSHNKFSGAIPNEIGTLSRLKTLDISNNALNGNLPATLSNLSSLTLLNAENNLLDNQIPQSLGRLRNLSVLILSRNQFSGHIPSSIANISSLRQLDLSLNNFSGEIPVSFDSQRSLNLFNVSYNSLSGSVPPLLAKKFNSSSFVGNIQLCGYSPSTPCLSQAPSQGVIAPPPEVSKHHHHRKLSTKDIILIVAGVLLVVLIILCCVLLFCLIRKRSTSKAGNGQATEGRAATMRTEKGVPPVAAGDVEAGGEAGGKLVHFDGPMAFTADDLLCATAEIMGKSTYGTVYKAILEDGSQVAVKRLREKITKGHREFESEVSVLGKIRHPNVLALRAYYLGPKGEKLLVFDYMSKGSLASFLHGGGTETFIDWPTRMKIAQDLARGLFCLHSQENIIHGNLTSSNVLLDENTNAKIADFGLSRLMSTAANSNVIATAGALGYRAPELSKLKKANTKTDIYSLGVILLELLTRKSPGVPMNGLDLPQWVASVVKEEWTNEVFDADLMRDASTVGDELLNTLKLALHCVDPSPSARPEVHQVLQQLEEIRPERSVTASPGDDIV

SEQ ID NO: 1109 - protein, 854 aa, Glycine max
  Clone ID: rhg1_a2704_amplicon
MVVAVEKTNLTSQSQCFNRVSDKKKERCKTHMNNVNPCCFLFLLCVWSLVVLPSCVRPVLCEDEGWDGVVVTASNLLALEAFKQELVDPEGFLRSWNDSGYGACSGGWVGIKCAKGQVIVIQLPWKGLRGRITDKIGQLQGLRKLSLHDNQIGGSIPSTLGLLPNLRGVQLFNNRLTGSIPLSLGFCPLLQSLDLSNNLLTGAIPYSLANSTKLYWLNLSFNSFSGPLPASLTHSFSLTFLSLQNNNLSGSLPNSWGGNSKNGFFRLQNLILDHNFFTGDVPASLGSLRELNEISLSHNKFSGAIPNEIGTLSRLKTLDISNNALNGNLPATLSNLSSLTLLNAENNLLDNQIPQSLGRLRNLSVLILSRNQFSGHIPSSIANISSLRQLDLSLNNFSGEIPVSFDSQRSLNLFNVSYNSLSGSVPPLLAKKFNSSSFVGNIQLCGYSPSTPCLSQAPSQGVIAPPPEVSKHHHHRKLSTKDIILIVAGVLLVVLIILCCVLLFCLIRKRSTSKAGNGQATEGRAATMRTEKGVPPVAAGDVEAGGEAGGKLVHFDGPMAFTADDLLCATAEIMGKSTYGTVYKAILEDGSQVAVKRLREKITKGHREFESEVSVLGKIRHPNVLALRAYYLGPKGEKLLVFDYMSKGSLASFLHGGGTETFIDWPTRMKIAQDLARGLFCLHSQENIIHGNLTSSNVLLDENTNAKIADFGLSRLMSTAANSNVIATAGALGYRAPELSKLKKANTKTDIYSLGVILLELLTRKSPGVPMNGLDLPQWVASVVKEEWTNEVFDADLMRDASTVGDELLNTLKLALHCVDPSPSARPEVHQVLQQLEEIRPERSVTASPGDDIV

SEQ ID NO: 1110 - protein, 877 aa, Glycine max
  Clone ID: rhg1_noir_amplicon
MDAYGMSSSNSKHVVDQKRSTMNMMITTILLRFWDRYDMNCDYTTNSYEPGTQLAPSSPRDTSVKLGDASSLVVLPSCVRPVLCEDEGWDGVVVTASNLLALEAFKQELVDPEGFLRSWNDSGYGACSGGWVGIKCAQGQVIVIQLPWKGLRGRITDKIGQLQGLRKLSLHDNQIGGSIPSTLGLLPNLRGVQLFNNRLTGSIPLSLGFCPLLQSLDLSNNLLTGAIPYSLANSTKLYWLNLSFNSFSGPLPASLTHSFSLTFLSLQNNNLSGSLPNSWGGNSKNGFFRLQNLILDNNFFTGDVPASLGSLRELNEISLSHNKFSGAIPNEIGTLSRLKTLDISNNALNGNLPATLSNLSSLTLLNAENNLLDNQIPQSLGRLRNLSVLILSRNQFSGHIPSSIANISSLRQLDLSLNNFSGEIPVSFDSQRSLNLFNVSYNSLSGSVPPLLAKKFNSSSFVGNIQLCGYSPSTPCLSQAPSQGVIAPPPEVSKHHHHRKLSTKDIILIVAGVLLVVLIILCCVLLFCLIRKRSTSKAGNGQATEGRAATMRTEKGVPPVAAGDVEAGGEAGGKLVHFDGPMAFTADDLLCATAEIMGKSTYGTVYKAILEDGSQVAVKRLREKITKGHREFESEVSVLGKIRHPNVLALRAYYLGPKGEKLLVFDYMSKGSLASFLHGGGTETFIDWPTRMKIAQDLARGLFCLHSQENIIHGNLTSSNVLLDENTNAKIADFGLSRLMSTAANSNVIATAGALGYRAPELSKLKKANTKTDIYSLGVILLELLTRKSPGVPMNGLDLPQWVASVVKEEWTNEVFDADLMRDASTVGDELLNTLKLALHCVDPSPSARPEVHQVLQQLEEIRPERSVTASPGDDIV

SEQ ID NO: 1111 - protein, 854 aa, Glycine max
  Clone ID: rhg1_noir_amplicon
MVVAVEKTNLTSQSQCFNRVSDKKKERCKTHMNNVNPCCFLFLLCVWSLVVLPSCVRPVLCEDEGWDGVVVTASNLLALEAFKQELVDPEGFLRSWNDSGYGACSGGWVGIKCAQGQVIVIQLPWKGLRGRITDKIGQLQGLRKLSLHDNQIGGSIPSTLGLLPNLRGVQLFNNRLTGSIPLSLGFCPLLQSLDLSNNLLTGAIPYSLANSTKLYWLNLSFNSFSGPLPASLTHSFSLTFLSLQNNNLSGSLPNSWGGNSKNGFFRLQNLILDNNFFTGDVPASLGSLRELNEISLSHNKFSGAIPNEIGTLSRLKTLDISNNALNGNLPATLSNLSSLTLLNAENNLLDNQIPQSLGRLRNLSVLILSRNQFSGHIPSSIANISSLRQLDLSLNNFSGEIPVSFDSQRSLNLFNVSYNSLSGSVPPLLAKKFNSSSFVGNIQLCGYSPSTPCLSQAPSQGVIAPPPEVSKHHHHRKLSTKDIILIVAGVLLVVLIILCCVLLFCLIRKRSTSKAGNGQATEGRAATMRTEKGVPPVAAGDVEAGGEAGGKLVHFDGPMAFTADDLLCATAEIMGKSTYGTVYKAILEDGSQVAVKRLREKITKGHREFESEVSVLGKIRHPNVLALRAYYLGPKGEKLLVFDYMSKGSLASFLHGGGTETFIDWPTRMKIAQDLARGLFCLHSQENIIHGNLTSSNVLLDENTNAKIADFGLSRLMSTAANSNVIATAGALGYRAPELSKLKKANTKTDIYSLGVILLELLTRKSPGVPMNGLDLPQWVASVVKEEWTNEVFDADLMRDASTVGDELLNTLKLALHCVDPSPSARPEVHQVLQQLEEIRPERSVTASPGDDIV

SEQ ID NO: 1112 - protein, 877 aa, Glycine max; identical to SEQ ID NO: 1110
  Clone ID: rhg1_lee_amplicon

SEQ ID NO: 1113 - protein, 854 aa, Glycine max; identical to SEQ ID NO: 1111
  Clone ID: rhg1_lee_amplicon

SEQ ID NO: 1114 - protein, 877 aa, Glycine max
  Clone ID: rhg1_pi200499_amplicon
MDACGMSSSNSKHVVDQKRSTMNMMITTILLRFWDRYDMNCDYTTNSYEPGTQLAPSSPRDTSVKLGDASSLVVLPSCVRPVLCEDEGWDGVVVTASNLLALEAFKQELVDPEGFLRSWNDSGYGACSGGWVGIKCAQGQVIVIQLPWKGLRGRITDKIGQLQGLRKLSLHDNQIGGSIPSTLGLLPNLRGVQLFNNRLTGSIPLSLGFCPLLQSLDLSNNLLTGAIPYSLANSTKLYWLNLSFNSFSGPLPASLTHSFSLTFLSLQNNNLSGSLPNSWGGNSKNGFFRLQNLILDNNFFTGDVPASLGSLRELNEISLSHNKFSGAIPNEIGTLSRLKTLDISNNALNGNLPATLSNLSSLTLLNAENNLLDNQIPQSLGRLRNLSVLILSRNQFSGHIPSSIANISSLRQLDLSLNNFSGEIPVSFDSQRSLNLFNVSYNSLSGSVPPLLAKKFNSSSFVGNIQLCGYSPSTPCLSQAPSQGVIAPPPEVSKHHHHRKLSTKDIILIVAGVLLVVLIILCCVLLFCLIRKRSTSKAGNGQATEGRAATMRTEKGVPPVAAGDVEAGGEAGGKLVHFDGPMAFTADDLLCATAEIMGKSTYGTVYKAILEDGSQVAVKRLREKITKGHREFESEVSVLGKIRHPNVLALRAYYLGPKGEKLLVFDYMSKGSLASFLHGGGTETFIDWPTRMKIAQDLARGLFCLHSQENIIHGNLTSSNVLLDENTNAKIADFGLSRLMSTAANSNVIATAGALGYRAPELSKLKKANTKTDIYSLGVILLELLTRKSPGVPMNGLDLPQWVASVVKEEWTNEVFDADLMRDASTVGDELLNTLKLALHCVDPSPSARPEVHQVLQQLEEIRPERSVTASPGDDIV

SEQ ID NO: 1115 - protein, 854 aa, Glycine max; identical to SEQ ID NO: 1111
  Clone ID: rhg1_pi200499_amplicon

SEQ ID NO: 1116 - protein, 894 aa, Glycine max; identical to SEQ ID NO: 1099
  Clone ID: rhg4_a3244_amplicon

SEQ ID NO: 1117 - protein, 894 aa, Glycine max; identical to SEQ ID NO: 1099
  Clone ID: rhg4_Minsoy_amplicon

SEQ ID NO: 1118 - protein, 894 aa, Glycine max
  Clone ID: rhg4_Jack_amplicon
MSNFLKSLTPPPSGWSETTPFCQWKGIQCDSSSHVTSISLASQSLTGTLPSDLNSLSQLRTLSLQDNSLTGTLPSLSNLSFLQTVYLNRNNFSSVSPTAFASLTSLQTLSLGSNPALQPWSFPTDLTSSSNLIDLDLATVSLTGPLPDIFDKFPSLQHLRLSYNNLTGNLPSSFSAANNLETLWLNNQAAGLSGTLLVLSNMSALNQSWLNKNQFTGSIPDLSQCTALSDLQLRDNQLTGVVPASLTSLPSLKKVSLDNNELQGPVPVFGKGVNVTLDGINSFCLDTPGNCDPRVMVLLQIAEAFGYPIRLAESWKGNDPCDGWNYVVCAAGKIITVNFEKQGLQGTISPAFANLTDLRTLFLNGNNLIGSIPDSLITLPQLQTLDVSDNNLSGLVPKFPPKVKLVTAGNALLGKPLSPGGGPSGTTPSGSSTGGSGGESSKGNSSVSPGWIAGIVVIVLFFIAVVLFVSWKCFVNKLQGKFSRVKGHENGKGGFKLDAVHVSNGYGGVPVELQSQSSGDRSDLHALDGPTFSIQVLRQVTNNFSEENILGRGGFGVVYKGVLHDGTKIAVKRMESVAMGNKGQKEFEAEIALLSKVRHRHLVALLGYCINGNERLLVYEYMPQGTLTQHLFEWQEHGYAPLTWKQRVVIALDVARGVEYLHSLAQQSFIHRDLKPSNILLGDDMRAKVADFGLVKNAPDGKYSVETRLAGTFGYLAPEYAATGRVTTKVDVYAFGVVLMELITGRKALDDTVPDERSHLVTWFRRVLINKENIPKAIDQILNPDEETMGSIYTVAELAGHCTAREPYQRPDMGHAVNVLVPLVEQWKPTSHDEEEEDGSGGDLHMSLPQALRRWQANEGTSSIFNDISISQTQSSISSKPAGFADSFDSMDCR

SEQ ID NO: 1119 - protein, 894 aa, Glycine max
  Clone ID: rhg4_peking_amplicon
MSNFLKSLTPPPSGWSETTPFCQWKGIQCDSSSHVTSISLASQSLTGTLPSDLNSLSQLRTLSLQDNSLTGTLPSLSNLSFLQTVYFNRNNFSSVSPTAFASLTSLQTLSLGSNPALQPWSFPTDLTSSSNLIDLDLATVSLTGPLPDIFDKFPSLQHLRLSYNNLTGNLPSSFSAANNLETLWLNNQAAGLSGTLLVLSNMSALNQSWLNKNQFTGSIPDLSQCTALSDLQLRDNQLTGVVPASLTSLPSLKKVSLDNNELQGPVPVFGKGVNVTLDGINSFCLDTPGNCDPRVMVLLQIAEAFGYPIRLAESWKGNDPCDGWNYVVCAAGKIITVNFEKQGLQGTISPAFANLTDLRTLFLNGNNLIGSIPDSLITLPQLQTLDVSDNNLSGLVPKFPPKVKLVTAGNALLGKPLSPGGGPSGTTPSGSSTGGSGGESSKGNSSVSPGWIAGIVVIVLFFIAVVLFVSWKCFVNKLQGKFSRVKGHENGKGGFKLDAVHVSNGYGGVPVELQSQSSGDRSDLHALDGPTFSIQVLRQVTNNFSEENILGRGGFGVVYKGVLHDGTKIAVKRMESVAMGNKGQKEFEAEIALLSKVRHRHLVALLGYCINGNERLLVYEYMPQGTLTQHLFEWQEHGYAPLTWKQRVVIALDVARGVEYLHSLAQQSFIHRDLKPSNILLGDDMRAKVADFGLVKNAPDGKYSVETRLAGTFGYLAPEYAATGRVTTKVDVYAFGVVLMELITGRKALDDTVPDERSHLVTWFRRVLINKENIPKAIDQILNPDEETMGSIYTVAELAGHCTAREPYQRPDMGHAVNVLVPLVEQWKPTSHDEEEEDGSGGDLHMSLPQALRRWQANEGTSSIFNDISISQTQSSISSKPAGFADSFDSMDCR

What is claimed is:

1. A method of introgressing an allele into a soybean plant comprising
   (A) crossing at least one SCN resistant soybean plant having an rhg1 SCN resistant allele with at least one SCN sensitive soybean plant having an rhg1 SCN sensitive allele in order to form a segregating population,
   (B) screening said segregating population with one or more nucleic acid markers to determine if one or more soybean plants from said segregating population contains a deletion of 19 nucleotides corresponding to SEQ ID NO: 2 and encompassing position 48881, and
   (C) selecting, if present, one or more soybean plants of said segregating population containing said deletion.

2. The method according to claim 1, wherein said one or more soybean plants of said segregating population have a yellow soybean seed.

3. A method of introgressing an allele from a first soybean plant comprising a polymorphism relative to a second soybean plant into a selected soybean plant comprising screening with one or more nucleic acid markers a population of soybean plants formed by a cross of said first and said second soybean plant and selecting a soybean plant, wherein said allele is an allele having one or more polymorphisms in a protein coding region corresponding to nucleotides 45163 to 45314, 45450 to 45509, 46941 to 48763 or 48975 to 49573 of SEQ ID NO: 2
   thereby introgressing said allele from said first soybean plant comprising a polymorphism into said selected soybean plant.

4. The method according to claim 3, wherein said polymorphisms selected from the group consisting of 45173, 45309, 47057, 47140, 47208, 47571, 47617, 47796, 47856, 47937, 48012, 48060, 48073, 48135, 48279, 48413, 48681, 49012, and 49316 of SEQ ID NO: 2.

5. The method according to claim 3, wherein said introgressing said allele into said selected soybean plant results in a yellow soybean seed.

6. A method of introgressing an allele comprising a polymorphism into a soybean plant lacking said polymorphism comprising screening a population of soybean plants with one or more nucleic acid markers and selecting a soybean plant, wherein said one or more nucleic acid markers are capable of detecting one or more polymorphisms located at a position in SEQ ID NO: 2 selected from the group consisting of 45173, 45309, 47057, 47140, 47208, 47571, 47617, 47796, 47856, 47937, 48012, 48060, 48073, 48135, 48279, 48413, 48681, 49012, and 49316,
   thereby selecting a soybean plant comprising said polymorphism.

7. The method according to claim 6, wherein said introgressing said allele comprising a polymorphism into said soybean plant results in one or more soybean plant having a yellow soybean seed and said polymorphism.

8. A method of introgressing an rhg1 SCN resistant allele into a non-resistant soybean plant comprising
   (A) crossing at least one SCN resistant soybean plant having said rhg1 SCN resistant allele corresponding to an rhg1 SCN resistant allele present in Peking with at least one SCN sensitive soybean plant having an rhg1 SCN sensitive allele in order to form a segregating population,
   (B) screening said segregating population with one or more nucleic acid markers to identify said rhg1 SCN resistant allele, wherein said one or more nucleic acid markers are capable of detecting a polymorphism located at a position in SEQ ID NO: 2 corresponding to nucleotides between 45163 and 49573, and
   (C) selecting one or more members of said segregating population having said rhg1 SCN resistant allele.

9. The method according to claim 8, wherein said one or more members of said segregating population have a yellow soybean seed.

10. The method according to claim 8, wherein said one or more nucleic acid markers are capable of detecting a single nucleotide polymorphism or INDEL mutation.

11. The method according to claim 8, wherein said one or more nucleic acid markers are capable of detecting one or more polymorphisms located at a position in SEQ ID NO: 2 selected from the group consisting of 45173, 45309, 47057, 47140, 47208, 47571, 47617, 47796, 47856, 47937, 48012, 48060, 48073, 48135, 48279, 48413, 48681, 49012, 49316, and 46703.

12. The method according to claim 8, wherein said one or more nucleic acid markers are capable of detecting single nucleotide polymorphisms.

13. The method according to claim 12, wherein said single nucleotide polymorphisms are located at a position in SEQ ID NO: 2 selected from the group consisting of 45173, 45309, 47057, 47140, 47208, 47571, 47617, 47796, 47856, 47937, 48012, 48060, 48073, 48135, 48279, 48413, 48681, 49012, and 49316.

14. The method according to claim 8, wherein said one or more nucleic acid markers are capable of detecting INDEL mutations.

* * * * *